US007235651B2

(12) United States Patent
Farnet et al.

(10) Patent No.: US 7,235,651 B2
(45) Date of Patent: Jun. 26, 2007

(54) GENES AND PROTEINS INVOLVED IN THE BIOSYNTHESIS OF LIPOPEPTIDES

(75) Inventors: Chris M. Farnet, Outremont (CA); Alfredo Staffa, Saint-Laurent (CA); Emmanuel Zazopoulos, Montreal (CA)

(73) Assignee: Cubist Pharmaceuticals, Inc., Lexington, MA (US)

( * ) Notice: Subject to any disclaimer, the term of this patent is extended or adjusted under 35 U.S.C. 154(b) by 486 days.

(21) Appl. No.: 10/329,079

(22) Filed: Dec. 24, 2002

(65) Prior Publication Data
US 2003/0198981 A1 Oct. 23, 2003

Related U.S. Application Data

(63) Continuation-in-part of application No. 10/232,370, filed on Sep. 3, 2002.

(60) Provisional application No. 60/372,789, filed on Apr. 17, 2002, provisional application No. 60/342,133, filed on Dec. 26, 2001.

(51) Int. Cl.
*C07H 21/02* (2006.01)

(52) U.S. Cl. ............... 536/23.1; 435/69.1; 435/320.1; 435/325; 435/440; 530/350; 530/387.1

(58) Field of Classification Search ............ 536/23.1; 435/320.1, 325
See application file for complete search history.

(56) References Cited

U.S. PATENT DOCUMENTS 4,001,397 A 1/1977 Celmer et al. ............. 424/116

| 4,208,403 A | 6/1980 | Hamill et al. ............. 424/115 |
| 4,427,656 A | 1/1984 | Cavalleri et al. ......... 424/118 |
| 4,946,778 A | 8/1990 | Ladner et al. ............ 435/69.6 |
| 4,994,270 A | 2/1991 | Boeck et al. ............. 424/118 |

FOREIGN PATENT DOCUMENTS

| CA | 2 352 451 | 10/2001 |
| EP | 0 337 731 | 10/1989 |
| WO | WO 00/40704 | 7/2000 |
| WO | WO 01/30985 A1 | 5/2001 |
| WO | WO 01/53533 | 7/2001 |
| WO | WO 02/059322 A3 | 8/2002 |

OTHER PUBLICATIONS de Crecy Lagard, et al. Journal of Bacteriology. 1997. vol. 179, pp. 705-713.*
Merriam-Webster's Medical Dictionary found at www.dictionary.com for defining "domain" and "sub-unit" 2002.*

(Continued)

*Primary Examiner*—John S. Brusca
*Assistant Examiner*—Russell S. Negin
(74) *Attorney, Agent, or Firm*—Sughrue Mion, PLLC

(57) ABSTRACT

Genes and proteins involved in the biosynthesis of lipopeptides by microorganisms, in particular the nucleic acids forming the biosynthetic locus for the A54145 lipopeptide from *Streptomyces fradiae* and the A54145-like lipopeptide from *Streptomyces refuineus*. These nucleic acids can be used to make expression constructs and transformed host cells for the production of lipopeptides. The genes and proteins allow direct manipulation of lipopeptides and related chemical structures via chemical engineering of the proteins involved in the biosynthesis of A54145.

17 Claims, 41 Drawing Sheets

OTHER PUBLICATIONS

Numrych et al. Characterization of the bacteriophage lambda excisionase (XIS) protein: the C-terminus is required for Xis-integrase cooperativity but not for DNA binding. The EMBO Journal, vol. 11, pp. 3797-3806, 1992.*

Wessels et al. Biosynthesis of acylpeptidolactones of the daptomycin type. European Journal of Biochemistry, vol. 242, 1996, pp. 665-673.*

Kleinkauf et al. A nonribosomal system of peptide biosynthesis. European Journal of Biochemistry, vol. 236, 1996, pp. 335-351.*

Sosio M., et al., Mol. Gen. Genet. (2000) vol. 264, pp. 213-221, "Multiple peptide Synthetase Gene Clusters in Actinomycetes."

McCafferty D. G., et al., Biopolymers (2002), vol. 66(4), pp. 261-284, "Chemistry and biology of the Ramoplanin Family of Peptide Antibiotics."

Micklefield, J., Chemistry & Biology (2004, vol. 11, pp. 887-895, "Daptomycin Structure and Mechanism of Action Revealed."

Baltz, R.H. et al., (1997), "Genetics of lipopeptide antibiotic biosynthesis in *Streptomyces fradiae* A54145 and *Streptomyces roseosporus* A21978", *Developments in Industrial Microbiology*, Ch. 15:93-98.

Wessels, P. et al., (1996), "Biosynthesis acylpeptidolactones of the daptomycin type A comparative analysis of peptide synthetases forming A21978C and A54145", *European Journal of Biochemistry*, 242:665-673.

Tang, L. et al., (2000), "Cloning and Heterologous Expression of the Epothilone Gene Cluster", *Science*, 287:640-642.

Keating, T.A et al., (2001), "Chain Termination Steps in Nonribosomal Peptide Synthetase Assembly Lines: Directed Acyl-S-Enzyme Breakdown in Antibiotic and Siderophore Biosynthesis", *Chembiochem*, 2: 99-107.

Linne, U. et al., (2000), "Control of Directionality in Nonribosomal Peptide Synthesis: Role of the Condensation Domain in Preventing Misinitiation and Timing of Epimerization", *Biochemistry*, 39: 10439-10447.

Keating, T.A. et al., (1999), "Initiation, elongation, and termination strategies in polyketide and polypeptide antibiotic biosynthesis", *Current Opinion in Chemical Biology*, 3: 598-606.

Baltz, R.H., "Lipopetide Antibiotics Produced by *Streptomyces roseosporus* and *Streptomyces fradia*", *Biotechnology of Antibiotics*, 2d Ed.:415-435, Date=1997.

Doekel, S. et al., (2001), "Biosynthesis of Natural Products on Modular Peptide Synthetases", *Metabolic Engineering*, 3:64-77.

Challis, G.L. et al., (2000), "Coelchelin, a new peptide siderophore encoded by the *Streptomyces coelicolor* genome: structure prediction from the sequence of its non-ribosomal peptide synthetase", *FEMS Microbial Letters*, 187(2):111-114.

Quadri, L. et al., (1998), "Identification of a *Mycobacterium tuberculosis* gene cluster encoding the biosynthetic enzymes for assembly of the virulence-conferring siderophore mycobactin", *Chemistry & Biology*, 5:631-645.

Altschul, S.F. et al., (1997), "Grapped BLAST and PSI-BLAST: a new generation of protein database search programs", *Nucleic Acids Res.*, 25(17):3389-3402.

McHenney, M.A. et al., (1998), "Molecular Cloning and Physical Mapping of the Daptomycin Gene Cluster from *Streptomyces roseosporus*", *J. Bact.*, 180(1):143-151.

Kang, Y. et al., (1998), "Characterization of Genes Involved in Biosynthesis of a Novel Antibiotic from *Burkholderia cepacia* BC11 and Their Role in Biological Control of *Rhizoctonia solani*", *Applied and Environmental Microbiology*, 64(10):3939-3947.

Guenzi, E. et al., (1998), "Characterization of the Syringomycin Synthetase Gene Cluster", *J. Biol. Chem.*, 273(49):32857-32863.

Lindum, P.W. et al., (1998), "N-Acyl-L-Homoserine Lactone Autoinducers Control Production of an Extracellular Lipopeptide Biosurfactant Required for Swarming Motility of *Serratia liquefaciens* MG1", *J. of Bacteriology*, 180(23):6384-6388.

Steller, S. et al., (1999), "Structural and functional organization of the fengycin synthetase multienzyme system form *Bacillus stubtilis* b213 and A1/3", *Chem. Biol.*, 6(1):31-41.

Konz, D. et al., (1999), "Molecular and Biochemical Characterization of the Protein Template Controlling Biosynthesis of the Lipopeptide Lichenysin", *J. Bact.*, 181(1):133-140.

Hino, M. et al., (2001), "Chemical diversity in lipopeptide antifungal antibiotics", *J. of Industrial Microbiol. and Biotechnol*, 27(3):157-162.

Duitman, E.H. et al., (1999), "The mycosubtilin synthetase of *Bacillus subtillis* ATCC6633: A multifunctional hybrid between a peptide synthetase, an amino transferase, and a fatty acid synthase", *Proc. Natl. Acad. Sci.*, 96(23):13294-13299.

Tsuge, K. et al., (2001), "Cloning, Sequencing, and Characterization of the Iturin A Operon", *J. Bact.*, 183(21):6265-6273.

Fitzmaurice, A.M. et al., (1997), "Open Reading Fram 3, Which is Adjacent to the Mycocerosic Acid and Synthase Gene, Is Expressed as an Acyl Coenzyme A Synthase in *Mycobacterium bovis* BCG", *J. Bact.*, 179(8):2608-2615.

Pearson, W.R. et al., (1988), "Improved tools for biological sequence comparison", *Proc. Natl. Acad. Sci.*, 85:2444-2448.

Altschul, S.F. et al., (1990), "Basic Local Alignment Search Tool", *J. Mol. Biol.*, 215:403-410.

Thompson, J.D. et al., (1994), "Clustal W: improving the sensitivity of progressive multiple sequence alignment through sequence weighting, position-specific gap penalties and weight matrix choice", *Nucl. Acids Res.*, 22(22):4673-4680.

Higgins, D.G. et al., (1996), "Using CLUSTAL for Multiple Sequence Alignments", *Methods Enzymol.*, 266:383-402.

Gish, W. et al., (1993), "Identification of protein coding regions by database similarity search", *Nature Genetics*, 3:266-272.

Karlin, S. et al., (1990), "Methods for assessing the statistical significance of molecular sequence features by using general scoring schemes", *Proc. Natl. Acad. Sci. USA*, 87:2264-2268.

Stachelhaus, T. et al., (1998), "Peptide Bond Formation in Nonribosomal Peptide Biosynthesis", *J. Biol. Chem.*, 273(35):22773-22781.

Fleischmann, R.D. et al., (1995), "Whole-Genome Random Sequencing and Assembly of *Haemophilus influenzae* Rd", *Science*, 269:496-512.

Huang, J. et al., (2001), "Global analysis of growth phase responsive gene expression and regulation of antibiotic biosynthetic pathways in *Streptomyces coelicolor* using DNA microarrays", *Genes Dev.*, 15:3183-3192.

Ryding, N.J. et al., (2002), "Regulation of the *Streptomyces coelicolor* Calcium-Dependent Antibiotic by absA, Encoding a Cluster-Linked Two-Component System", *J. Bact.*, 184(3):794-805.

Kagan, R.M. et al., (1994), "Widespread Occurrence of Three Sequence Motifs in Diverse S-Adenosylmethionine-Dependent methyltransferases Suggests a Common Structure for These Enzymes", *Arch. Biochem. Biophys.*, 310(2):417-427.

Vidgren, J. et al., (1994), "Crystal structure of catechol O-methyltransferase", *Nature*, 368(6469):354-358.

Bentley, S.D. et al., (2002), "Complete genome sequence of the model actinomycete *Streptomyces coelicolor* A3(2)", *Nature*, 417:141-147.

Gluzman, Y., (1981), "SV40-Transformed Simian Cells Support the Replication of Early SV40 Mutants", *Cell*, 23:175-182.

Cadwell, R.C. et al., (1992), "Randomization of Genes by PCR Mutagenesis", *PCR Methods and Applications*, 2:28-33.

Reidhaar-Olson, J.F. et al., (1998), "Combinatorial Cassette Mutagenesis as a Probe of the Informational Content of Protein Sequences", *Science*, 241:53-57.

Köhler, G. et al., (1975), "Continuous cultures of fused cells secreting antibody of predefined specificity", *Nature*, 256:495-497.

Kozbor, D. et al., (1983), "The production of monoclonal antibodies from human lymphocytes", *Immunology Today*, 4(3):72-79.

Cole, S.P.C. et al., (1985), "The EBV-Hybridoma Technique and Its Application of Human Lung Cancer", *Monoclonal Antibodies and Cancer Therapy*, Alan R. Liss, Inc., pp. 77-96.

Wood, T.M. et al., (1998), "Methods for Measuring Cellulase Activities", *Methods of Enzymology*, 160:87-116.

Hojati, Z. et al., (2002), "Structure, Biosynthetic Origin, and Engineered Biosynthesis of Calcium-Dependent Antibiotics from *Streptomyces coelicolor*", *Chem. Biol.*, 9(11):1175-1187.

Mootz, H.D. et al., (2000), "Contruction of hybrid peptide synthetases by module and domain fusions", *Proc. Natl. Acad. Sci. USA*, 97(11):5848-5853.

Chiu, H.T. et al., (2001), "Molecular cloning and sequence analysis of the complestatin biosynthetic gene cluster", 98(15):8548-8553, PNAS USA.

Ōmura, S. et al., (2001), "Genome sequence of an industrial microorganism *Streptomyces avermitils*: Deducing the ability of producing secondary metabolites", *PNAS*, 98(21):12215-12220.

Database Swall [Online] Dec. 1, 2001, XP002254223 Accession No. EBI. Database Accession No. Q93HG9, abstract.

Database Swall [Online] Dec. 1, 2001, XP002254224 Accession No. EBI. Database Accession No. Q93HB6, abstract.

Database Swall [Online] Dec. 1, 2001, XP002254225 Accession No. EBI. Database Accession No. Q93H11, abstract.

Database Trembl [Online] Jun. 1, 1998, XP002254226 Accession No. EBI. Database Accession No. O54155, abstract.

Sosio M., et al., Mol. Gen Genet. (2000) vol. 264, pp. 213-221, "Multiple peptide synthetase Gene Clusters in Actinomycetes.".

McCafferty D. G., et al., Biopolymers (2002), vol. 66(4), pp. 261-284, "Chemistry and biology of the Ramoplanin Family of Peptide Antibiotics."

Micklefield, J., Chemistry & Biology (2004), vol. 11, pp. 887-895, "Daptomycin Structure and Mechanism of Action Revealed."

Baltz, R.H. et al., (1997), "Genetics of lipopeptide antibiotic biosynthesis in *Streptomyces fradiae* A54145 and *Streptomyces roseosporus* A21978", *Developments in Industrial Microbiology*, Ch. 15:93-98.

Hosted, T.J. et al., (1996), "Cloning and DNA Sequence Scanning of the *Streptomyces fradiae* Lipopeptide Antibiotic Biosynthetic Gene Cluster", *Gen. Meet. Am. Soc. Microbiol.*, Abstract, 96:19.

Wessels, P. et al., (21996), "Biosynthesis of acylpeptidolactones of the daptomycin type A comparative analysis of peptide synthetases forming A21978C and A54145", *European Journal of Biochemistry*, 242:665-673.

Tang, L. et al., (2000), "Cloning and Heterologous Expression of the Epothilone Gene Cluster", *Science*, 287:640-642.

Marahiel, M.A., Chem. Rev. (1997) vol. 97, pp. 2651-2673 "Modular peptide synthetases involved in nonribosomal peptide synthesis".

Konz, D. and Marahiel, M.A., Chemistry & Biology (1999) vol. 6, pp. R39-R48 "How do peptide synthetases generate structural diversity?".

Weber T. and Marahiel, M.A., Structure (2001) vol. 9, pp. R3-R9 "Exploring the domain structure of modular nonribosomal peptide synthetases".

Stachelhaus T. et al., Chemistry and Biology (1999) vol. 6, pp. 493-505 "The specificity-conferring code of adenylation domains in nonribosomal peptide synthetases".

Schwarzer, D. and Marahiel, M.A., Naturwissenschaften (2001) vol. 88, pp. 93-101 "Multimodular biocatalysts for natural product assembly".

Du L. et al., Metabolic Engineering (2001) vol. 3, pp. 78-95 "Hybrid peptide-polyketide natural products: biosynthesis and prospects toward engineering novel molecules".

Kohli, R.M. et al., Biochemistry (2001) vol. 40, No. 24, pp. 7099-7108 "Generality of peptide cyclization catalyzed by isolated thioesterase domains of nonribosomal peptide . . . ".

Schneider, A. et al., Mol Gen Genet (1998) vol. 257, pp. 308-318 "Targeted alteration of the substrate specificity of peptide synthetases by rational module swapping".

Schauwecker, F. et al. Chemistry & Biology (2000) vol. 7, pp. 287-297 "Construction and in vitro analysis of a new bi-modular polypeptide synthetase for synthesis . . . ".

Doekel, S. and Marahiel M.A. Chemistry & Biology (2000) vol 7 pp. 373-384 "Dipeptide formation on engineered hybrid peptide synthetases".

Eppelmann, K. et al., Biochemistry (2002) vol. 41, pp. 9718-9726 "Exploitation of the selectivity-conferring code of nonribosomal peptide synthetases . . . ".

* cited by examiner

Figure 3a

```
                         C1                                                      C2
ORF3_nCD02|A541    PDRVPLSSAQRRLWFLGELE--GPSATYNIPLALRLRGRLDVDALRTALADVVGRHEALR
ORF5_nCD01|A541    --MLPLSLAQQRLWFLHTMD--GPSSTYNIPTALRMTGPLDVTALGEALRDVVRRHETLR
ORF6_nCD02|A541    PEHVPLSFSQQRLWIMHRLT--GPDATYNIHRALRLDGDLDVPALEAALHDVTERHETLR
ORF5_nCD03|A541    PGRLPLSYAQLRLWLLHQIE--GPSATYTIPLALRLTGPLDVAALRAALGDVVARHESLR
ORF5_nCD04|A541    PERLPLSHAQRRLWFVRQLE--GPSATYNVPWALRLTGPLDVAALRAALGDVVARHESLR
ORF4_nCD02|A541    PDRVPLSFAQRRLWFLHRLQ--GHSAAYHVPLALRLTGRLDPAALRGAIADTVARHGSLR
ORF3_nCD01|A541    PERLPLSPAQRRLWFLNRYD--REAGGYHISVAIRLTGDLDVDALHAALGDLTARHESLR
ORF2_nCD02|A541    PERLPLSSAQRRLWFIDELN--GASAAYNIPTVLHLEGPLDVPALHAALGDVTDRHETLR
ORF2_nCD03|A541    ADLLALAPAQEGLLFHSTFD-DAAEDVYVGQLALEFHGELSGARMREAAQQVLDRHDVLR
ORF4_nCD01|A541    EEVLAVTPLQEGLLFHAVFD-ENVPDAYVSRLVLALSGELDADRLRQAAQALVARHPALR
ORF5_nCD02|A541    EDILPVAPLQEGLLFHSVYD-RRALDVYVGQLAFRLEGEIDQDALRTAAAALLARHTSLR
ORF6_nCD01|A541    QDVLPLSPLQEGLLFHSEYVGDEAVDVYTVQTEVELRGPLDVPALRAAAEAVLRRHDNLR
ORF2_nCD01|A541    AHRVAATSAQTGIWTAQRLR--GDDRLYACGLFLELD-HVVEEVLSEAIRRAVADTEALR
                    : .  :    *   :          *          . :    :   :  *       **

C2
ORF3_nCD02|A541    TVFPSEDG-----APYQQVVAAERAAPALDVVD----------VTEKELPAALAEARAHA
ORF5_nCD01|A541    TVFPDTGD-----GARQHVLPADGTAVELAVTR----------STEHELPAALAHEAGHA
ORF6_nCD02|A541    TVFPEGPE-----GPYQKVLPARREDGTLTVLP----------VADREVDRTLAELAAHR
ORF5_nCD03|A541    TVFAEDEH-----GPHQIVLAPGDAEPGLKAVP----------TTEDRLRSDLEAEAARP
ORF5_nCD04|A541    TVFAEDEH-----GPHQVVLSADGPAPLSGPVR----------TDEDALPRLLREAADHA
ORF4_nCD02|A541    TVFHEDAE-----GVRQIVQDASAAARLITLIP----------EPVEDPLRAAEEAVAEP
ORF3_nCD01|A541    TVFREDEQ-----GPHQVVLDPG-APPAPAVVP----------AAAHRIDALVREAVRRP
ORF2_nCD02|A541    TTLRPPADDGSAGAPEQHIAPPGGHRPPLPVLD----------VAPEALAGELRAAAGHV
ORF2_nCD03|A541    AAFLQRRSGEWSQAIAARTPVPWEEHDLSALAG---------EERERRLDALLAGHRTRR
ORF4_nCD01|A541    SAFRQRRSGEWFQLVATRPAVPWQELDLRPSGSP--------AEADKHLEALLDEHHRTG
ORF5_nCD02|A541    TGFHQRESGQWVQAVARSVELPWQFHDLLDPHGAGGAAGAADAGSGRRWEELAAAERVER
ORF6_nCD01|A541    AGFATRALKDPVQFVPREVELPWEEADLRAADDP-------DAEAARR----LEEHRWRR
ORF2_nCD01|A541    TAFREDADG--ALEQHVLARPPSTQTRLFHADPSG------GTPSRSASLDWMDRQRAQP
                    : :

C3
ORF3_nCD02|A541    FTLTEDLPLRAVLLR-------------TGPADHVLSLVLHHIAGDGWSLAPLARDLSTA
ORF5_nCD01|A541    FDLAREVPIRARLFV-------------LGEREHVLCLVIHHIASDGWSRTPLARDLATA
ORF6_nCD02|A541    FDLESEPPKRAWLLE-------------SGPRSRVLVLVLHHIASDGWSGRRLLRDLFTA
ORF5_nCD03|A541    FDLGQAPPVHARLFV-------------LDERTHVLLLAVHHIAMDGWSVRPLVRDLASA
ORF5_nCD04|A541    FRLDAEPPLRAHLFA-------------TAPEDHTLLLVMHHIATDAWSQRPLIADLAAA
ORF4_nCD02|A541    FDLTAGPPLRCRLFTRSADPADPRAGAGQEPQEHLFLLVVHHIAADGWSLRIIARDVAAA
ORF3_nCD01|A541    FDLADDIPLRHTLFT-------------LPDGEHVLLLVIHHIAADGWSMGPLARDLAAA
ORF2_nCD02|A541    FDLARDLPVRATLYR-------------TGELEHALLLLVHHVAADGASMGPLIGDLATA
ORF2_nCD03|A541    FDLARPPLVRFLLVT-------------TAADRHVLAVTNHHLVLDGWSLPLVVRDLMAL
ORF4_nCD01|A541    FDLGRPPLLRFLLAR-------------TGDDHHRLAVTYHHLVLDGWSMPILMRELAVL
ORF5_nCD02|A541    FDLTRPPLVRFLLAR-------------TAPERYQFVITTHHTIVDGWSIPILLRELLAL
ORF6_nCD01|A541    FRPSKPPLVRFLLLR-------------TAHDRHRFALTNHHILLDGWSMPMLLRELMLL
ORF2_nCD01|A541    WDLASGDTCRHTLIP-------------LGGDRSLLHLRYHHLALDGYGAALYLDRLAAV
                    :             :    *              : :  **    *. .          :

C4
ORF3_nCD02|A541    YAARREGRAPQWRPLPVQYADHTLWKEELLGAADD---PESL----------LARQLAFWR
ORF5_nCD01|A541    YAARGAGHAPRWEELPVQYGDYTLWQRELLGSQDD---PESL----------LSRQTAYWK
ORF6_nCD02|A541    YTARRAGRAPQWRPLPVQYADYALWQRRHLGDPAD---PASP----------AAVQGEYWE
ORF5_nCD03|A541    YAARRRGASLDLPALPVQYADYTLWQHEELGSEDD---PDSP----------LAAQLRYWR
ORF5_nCD04|A541    YAARHAGRVPTLPPLPVAYADYALWQQARLGDERE---KDSA----------LSAQLAYWR
ORF4_nCD02|A541    YAARVRGEDFAPAPPPVDYVDHTLWQHRVLGDPDADGGPDTEGGHATEGGPLDTQLAHWR
ORF3_nCD01|A541    YRARAAGRAPDWPAPAARPAAHPPGQH---GDDVD----DT----------VDRRLAHWA
ORF2_nCD02|A541    YTARLAGRAPVLPPPEVTYADFALWER---GSRER----SAA----------QAEGIDYWR
ORF2_nCD03|A541    YGTDG-----AALPAVRPYRDYLAWLA---GQDAD---------------AAHAAWA
ORF4_nCD01|A541    YGSGGD---PSALPPVRPHRDHLDWLA---RRPSE----------------RSARAWR
ORF5_nCD02|A541    YGGDP-------LPPAPGHRLHADWLA---ARDLV---------------AAREAWT
ORF6_nCD01|A541    YRTGGD---ASALPPVRRYRDYLAWLG---GRDRG---------------TAREAWR
ORF2_nCD01|A541    YRALRTG----HQPPPCAFAPLARLVEEDHAYRNS---AR----------HRADANHWR
                   *                                                              *
```

Figure 3b

```
ORF3_nCD02|A541  EALEGAPEQIELPTDRPRPAMESHRG---------AIHRFTLPASLRDRLRDLAHARRAT
ORF5_nCD01|A541  QRLAGLPDAIELPLDRPRPPIAGHRG---------DTVPFTLPPATHERVAALAARHGAT
ORF6_nCD02|A541  KQLAGLPEELRLPADRPRPARPTRTG---------GQVWLTLPATAHAAVAELARTSRAS
ORF5_nCD03|A541  RTLDGLPQESAPAADRPRPATPSYRG---------GRVALTVPPELHGRVVELAREFRAT
ORF5_nCD04|A541  DALAGSPEELALPADRPRPAVPSHRG---------DSVPLTVPPELHGRVVELAREFRAT
ORF4_nCD02|A541  RRLAGLPQEIALPADRQRPAASSHRG---------ADVDFTVPAAAAERIRQLAGTTGTT
ORF3_nCD01|A541  EELRGLPDELALPYDRPRPTTPPGYA---------ERVPFRVDAALYRDVRALAARHRAT
ORF2_nCD02|A541  RALAGLPDHIRLPADRPRSQEPVRRG---------GIARFEVPPALYAGLVELAQGVGAT
ORF2_nCD03|A541  QALAGLQ-PSLMAPDAPRDGAAP------------LAHHRTMDPDVVSRLTAWSRRLGVT
ORF4_nCD01|A541  QALAGLPGPTLIAPDADRNGPLP------------GSVWTRLGERDTHALGAWARARGVT
ORF5_nCD02|A541  RALADTEGPTLLAPGAPRVGEVP------------RSVRLNLPEEVSARLLTRAREAGAT
ORF6_nCD01|A541  AALAGLEAPTLIAPRADRAAEAP------------TWLDFTLSETASAGLSAAARAAGLT
ORF2_nCD01|A541  DRFADLPRPTSLADATTPAAPTTPATPAAPAAPDELRRTVRLSAARSAALRRASDRSGRP
                   :  .                                 :        :      :    .

C5
ORF3_nCD02|A541  LFMALQAGLAALFATLGAGRDIVLGTPVAGRAD---EAADDLVGFFVNTLALRTDLGGDPT
ORF5_nCD01|A541  TFMVVQAALAGLLSRLGAGTDIPLGTPVAGRTD--AALEGLIGFFVNTLVLRTDTSGNPT
ORF6_nCD02|A541  VFMVVQAAVAAFLTRMGAGEDIPIGAPVAGRTD--EAVEELVGFFVSTLVLRTDTSGDPS
ORF5_nCD03|A541  PFMVVHAALAALLTRLGAGTDVPIGSPVAGRVD--DALEDLVGFFVNTLVLRTDTSGDPT
ORF5_nCD04|A541  PFMVVHAALAALLTRLGAGTDVPIGSPVAGRVD--DALEDLVGFFVNTLVLRTDTSGDPT
ORF4_nCD02|A541  PFMVLQAALAVLLHRMGAGTDIPLGTPVAGRTD--SAVEGVVGLFVNTLVLRTDLSGSPT
ORF3_nCD01|A541  PFMVLHAALAALWHRLGAGPDIPVGTPSAGRDR--PETADLVGFLVNTLVLRTDTSGDPA
ORF2_nCD02|A541  PFMVLQTAIAVLLSRMGAGTDIPLGTPVAGRQD--EALDGLVGCFVNTVVLRTDVSGDPT
ORF2_nCD03|A541  LNSVVETAWALLLGRLTGRDDVSFGIAASGRPTDLPGAGEIVGLLMNTVPVRVTLDPAEP
ORF4_nCD01|A541  VNSAVQAAWATVIGRLTGRDDVVFGTTVSGRPPDLPGSEDMVGFFINTVPTRVRMRPAEP
ORF5_nCD02|A541  LNSVVQAVWLVLAQETGRSDVTFGITVSGRPAELPGAENLVGMLVNKVPLRVRLRPAEP
ORF6_nCD01|A541  LNTVVQGLWALTLARTTGSQDVVYGVVVSGRPPELDGVESMIGLFANTVPLRARMPVDEP
ORF2_nCD01|A541  WPVYATAAVAAFLSRLAPGEEVVVGLPVTARVT--PAAVRTPGMLANVVPLRLPVRQGMS
                   *           ::   *   :.*              *  :  : *          .

C6                       C7
ORF3_nCD02|A541  FEELLDRVREADLSAFAHQDIPFEQLVEALNPTRSLSRHPVFQVLLALQNNERGE----A
ORF5_nCD01|A541  FDELVERARACALDAYAHQDVPFERLVETLAPERSLARHPLFQVSLSLQHATDHT----A
ORF6_nCD02|A541  FTELVGRVRETALAAYAHQDLPFEYVVERLSPTRSLGRHPLFQVALSCNNTEEQLGROQA
ORF5_nCD03|A541  FGELLERVRATDLGAYAHQDLPFERLVEVLNPERSLARHPLFQILLAFNNGAAPDEGPAD
ORF5_nCD04|A541  FGELLERVRATDLGAYAHQDLPFERLVELRDPERSLARHPLFQVSLNYDTAETARARDAA
ORF4_nCD02|A541  FAQLLGRVRATALDAYAHQDVPFERLVEVLAPERSLARHPLFQVSLVLQNLDEAAAP-VD
ORF3_nCD01|A541  FAELLDRVRETDLRAYAHQDVPFERLVEAVNPARSPSRHPLVQTMLTFDNAAHGALDHLL
ORF2_nCD02|A541  TTELLARTRDGDLEALAHQDVPFDRVVEAVNPVRSTSRHPLFQVMLILNGSDQDRHR--A
ORF2_nCD03|A541  LEALVRRVQREQAALLDHQFLPLAQVQQSLG--AG----DLFDTTLVFENYP------LA
ORF4_nCD01|A541  IGDLVVRIQREQTALMEHQHVRLSDIQRWSD--RT----VLFDTSTAFENYP------AD
ORF5_nCD02|A541  LMELARRLEREQLELLEHQHVPLTTLHRWSG--LP----ELFDTTMVFENYP------AE
ORF6_nCD01|A541  LTDFLRRLQREQSALLDHQHLRLADIQRLAG--QG----ELFDSVMAFENYPDGP---AD
ORF2_nCD01|A541  TAELLELTAAEISTTLRHQRHRTEDIGRALGLHGAPPATTLVNVMAFAPVLD--------
                   :              **        :   .              :.:

ORF3_nCD02|A541  VMPG-LEVTVERPAQAAAKYDLFVNLVESRNEEDGTTAVEGAVEYATDLFDARTVARLTE
ORF5_nCD01|A541  LLNG-LEIAPLDTGWRAAKFDLSFDLLEKRGPDGRPDGIAGTVEYSTDVLDAATVRGLGE
ORF6_nCD02|A541  PPPG-LSVTPHQVDAARSKFDLMFTFLENHGEDGQPTGIETALEYSADLFDRETAQSLLD
ORF5_nCD03|A541  RASD-VLVRPETVEIAAAKFDLSLSFNEDRAADGTAAGMRGVLEYSADLYDESTARRMAE
ORF5_nCD04|A541  PELDGLTVSGRPLGVTTSKFDLTFALTETRAHDGGPAGLRGALEYSTDLFDRGTAERLAE
ORF4_nCD02|A541  GLPG-LRAETVRTRRDGAKVDLSFVLAPG-GPEGG--DMPGVLTYSADLFDHATARGLVD
ORF3_nCD01|A541  DLPG-VRAELLPTAEGTAHTDIELTFTETTADTDG-DGLDASLRYRPDLFDRTTARALAE
ORF2_nCD02|A541  RFPR-LADRVETVEPGETKFDLSWHFTHRDGPDRS---LEGALVHAADLFDDDTAHRLTA
ORF2_nCD03|A541  PADGLGDG--DGLRLQGARGHDGNHYPLSVT-VGPAPDLQLRFIHRPDLFTPPWVEDLAA
ORF4_nCD01|A541  DLSAVSSAGHAGLRIEGGSGRTTNHFPLSLY-ALPGPALRLRLDHRPDAVDDVTTRHAAD
ORF5_nCD02|A541  VTARQAP-----FRASGTASYSRNHYPLTLVGAMRGTELTVRVDHRPDLFDEDFARSLGE
ORF6_nCD01|A541  EPSGASADTPGHVRVVASRMRDAMHYPLGLL-ASPGTRMRFRLGHRPSAVTPRLAAALRD
ORF2_nCD01|A541  -FGDCRAPVHQLSAGPVEDLVVNLLGTPGDGGESDGTELEITVAANPRLHSADAVASLAA
                                               :                  .    .
```

Figure 3c

```
ORF3_nCD02|A541     RYHDLLLAAVEEPTTRLSRMPMLDTAERDRLTAEWG
ORF5_nCD01|A541     RLVRLLEAGTAAPEARLLSIDLLSAEERRRVLEEFA
ORF6_nCD02|A541     RFARMLAIWAAEPAAAIGARELLAADERHTVVTAWN
ORF5_nCD03|A541     RYLRLLEAAVAEPRTPLSRIPVLSEAELHDVLVRRN
ORF5_nCD04|A541     RFARVLQAAVAAPGTRLDQIDVLLPGERALLEGEWS
ORF4_nCD02|A541     RLLRVLDQVLAAPATPVGRVDVLLPGEARRELEHSR
ORF3_nCD01|A541     RFMALLRTVTREPALRLGQLDVTTAGERRRLADADA
ORF2_nCD02|A541     RLLDVLTAMVDDPARPVGTIDVLSAAEHR-LVRAWG
ORF2_nCD03|A541     RFEQVLDAMATSGDTPAGRLDILLPREHDTLLGDWA
ORF4_nCD01|A541     LLERALTAVHSAPATPTAALAATPATARAAAPRAA-
ORF5_nCD02|A541     RVIAALTEAADHPFVPAGTLDLLGAEERARLLEWG-
ORF6_nCD01|A541     RLLRLVDAFLATPHLPLGRFDVLDDAERALVLDTFN
ORF2_nCD01|A541     RLAEFLTHMGQDAEAPLGRTRLLDAEE---------
                                       :
```

Figure 4a

```
                                       A1
ORF2_nAD01|A541    DAPAVSS--DRATWTYAQLDAHAERVARRLAARG---VGPESLVALAVPRGVELAALILG
ORF6_nAD02|A541    HATALEH--AGHHLTYAELNARANRLARVLVRRG---IRPEHRVAILMPRSVEQITALLA
ORF3_nAD01|A541    AAPALTD--GPATLDYAELDARSNRLARALLGLG---VGPEDFVALAVPRSADLVVAVLA
ORF2_nAD02|A541    DAPAVTE--PGRVWSYAELDARADRVAAALAARG---IGAEDLVAVLLPRGAELVATLLG
ORF6_nAD01|A541    ARIAVET--ADRSVDYARLADRSGRLARLLAEHG---ARAERFVALVLPRSPELVETALA
ORF4_nAD02|A541    DAPALRW--DGGRLTYAELDRKADAVARALVGRS---LGPEDVVAVVAPRDPDVVAALLG
ORF5_nAD02|A541    DAPAVIS--SDGVLTYAELDRQANGVARWLAGRAGSAGGAEVHIGVLAPRRPEVLAVLLG
ORF2_nAD03|A541    DVLALVEGGDGARLSYAEFDARANRMARFLIARG---LGAEDLVGLVFPRGADLLTGLWG
ORF5_nAD04|A541    HAPAVRD--GDRELSYAELNDRANRLARFLAARG---AGPEDTVAVLLPRGPELITALVA
ORF5_nAD01|A541    EAPAVVG--GPVALTFAEADARVSRLARLLISRG---AGPEVRVAVCLDRNALWPTTVLA
ORF5_nAD03|A541    RATALVV--GEERLDYAELDARAERLATLLSRST---AGRGGPVAVALPRGVMLPVALLA
ORF3_nAN02|A541    --------------------PE------SR----------VAVCLPRTADLVAALLG
ORF4_nAD01|A541    EAPAVLA--GGEELTYAELDARANRLARLLLERG---VGPESRVALTVSRNAWLPVAVLG
                                        :.:         *

A2
ORF2_nAD01|A541    IQRAGGAYLPIDPEYPAERVGFLLRDARPALLVGG----TGTEPSAA----DCPRVPAEE
ORF6_nAD02|A541    ITKAGGAAVPVDPGHPGQRIAFMLRDSACALILAD----HPHAAGRE----EIAGVPVLV
ORF3_nAD01|A541    VLKSGAAYLAVDPDHPAERTSYILHDCRPVAVLST----TAVRETLHGTVGEAVGEVPWL
ORF2_nAD02|A541    ILRAGAAYLPLDTGHPADRNRRALSDSAPALLVTD----AGRSRTLRG---ETG--CAAL
ORF6_nAD01|A541    VWQTGAAYVPVDPAHPADRMARLLREADPVLTVTT----ADLADRLP-----AG--LPLL
ORF4_nAD02|A541    VLRCGAAYLPIDEAWPPARIRRTTTDAGARLLLAPGDTDAARTAFGP----ACGPDTDIL
ORF5_nAD02|A541    VLKSGAAYVPLDEQWPAERLRTVLEDCRPALVLAP--T-AARSDAAR----ESG--ATVL
ORF2_nAD03|A541    ALKAGAAYLPVDVDYPAERIALLLGDGNPALVLTT----SAHAHLVP----EAP-GRQIL
ORF5_nAD04|A541    VQKAGAAYVPMDAELPAERIAHMLENARPVLVLAH----TATQDALPE---GAG---PVV
ORF5_nAD01|A541    VLRSGAVHVPLDPRSPHERLAAVERDVAPLLVLAER---ATEAAVADL---AAP----VL
ORF5_nAD03|A541    VWKAGLHYLPLDPDHPSRLADVLADSAPGCVITT----TDLARRLPPV--PAPLL---V
ORF3_nAN02|A541    VLRAGAAYVPLDPEYPDERVAAILADTRPVALLTT----ADCR--------PAITG---A
ORF4_nAD01|A541    ILKAGGCYVPVGATLPRERAARILRETAPVCLLTD----PDAEAARTRR--TAPTGDDRD
                    : *    :.: .      * *       :         :

A3
ORF2_nAD01|A541    LLDAGAC------RAEADVPP---------PGSLPVDLPAYVVHTSGSTGRPKGVVVTHA
ORF6_nAD02|A541    PADEPAP------ERATDLADG------DRNAPLTAGHAAYVVYTSGSTGRPKGVVTEHR
ORF3_nAD01|A541    LLDEPATGGATAGHSAAPVTDA------DRRSPLLPDHPAYTIYTSGSTGRPKGVVVSHA
ORF2_nAD02|A541    VLGAEDTERELADRAPLPRDGA------GLVRPVTGDNAAYTILTSGSTGRPKAVVVTRD
ORF6_nAD01|A541    VLDGPSTAAALQALPGGPLTAS------ELPAPVDPRNAAYALYTSGSTGRPKGVVATHR
ORF4_nAD02|A541    GLEDPAFR---ATGGPALPAGR------N-----HPRSLAYVLYTSGSTGRPKGVGVERR
ORF5_nAD02|A541    PVDPAALA---AHG-PQTPTDA------ERIRPLTPGAAAYALYTSGSTGRPKGVVIDHS
ORF2_nAD03|A541    CVDLPGPADELARAAEGRVTDS------ELPRPVGPDTLAYVLYTSGSTGRPKGVAVGRG
ORF5_nAD04|A541    RLDAPAIEAALAGLDGGDCTDA------DRRAPATHHDPAYVVYTSGSTGTPKGVVVEQR
ORF5_nAD01|A541    VLDDPSTEAATDALDPGPVTDA------DRTAPLLPGHAAYVIHTSGSTGRPKGVTVDHR
ORF5_nAD03|A541    LDDPATAARLAATTATALAEDPR-----EQNGE-WGEELAYTIYTSGSTGRPKGVMVTRS
ORF3_nAN02|A541    ATAAGGAVLLAADAAHGAGPVP------EPPAP-LPDQAAYVLHTSGSTGRPKGVVVSRG
ORF4_nAD01|A541    ENAPGGVERVVLTGALLAAFDPAPPTDAERAGPLLPGHLAYLLHTSGSSGRPKGVAVEHA
                                              **  :  ****:*  **.*      :

A4
ORF2_nAD01|A541    GIAALAAEQI----ERYRLGPGS--RVAQLAALGFDVAVAELVMALASGSCLVLPP-HGL
ORF6_nAD02|A541    GLLSLATAQR----ERYPVGPGS--RVLQLASPSFDGAVLELLMALTTGGTLVLPDGPLL
ORF3_nAD01|A541    NVSRLLTACR----AAVDFGPDD--VWTLFHSSAFDFSVWEMWGPLAHGGRLVVVP-HDV
ORF2_nAD02|A541    ALDAFVDRAL----DTYGDALGG--EALLHSPVAFDLTVVTLYGPLAAGGRVRVGDLDES
ORF6_nAD01|A541    SLVGYLLRGS----AQY--PSDG--RSLVHSPVSFDLTVGALYVPLISGGTVRLASLDDE
ORF4_nAD02|A541    ALAHYVEGAV----HRYP-DAAA--TTLLHSPLTFDLSATALFTPLASGGCVVLGEVDRA
ORF5_nAD02|A541    ALAAYVGGAR----RRYP-DAAG--TSLAHTSLAFDLTVTLLTPLTAGGAVRLGELDET
ORF2_nAD03|A541    SLAAHAVRSR----DRYP-DAAG--VSLLHSPVAFDLTVALFTTLISGGTLLLAELDEH
ORF5_nAD04|A541    SLAAFLVRSA----ARYR-GAAG--TALLHGSPAFDLTVTTLFTPLIAGGCIVVADLDAP
ORF5_nAD01|A541    GLSRLLQAHRRVTFSRIRPSAGGPGRAAHVSSFSFDASWDPLLA-MVAGHELHMIDEDLR
ORF5_nAD03|A541    AVANFLADMN----ERLELGPGD--RLLAVTTVSFDIAVLELLAPLLTGGTVVLADATTQ
ORF3_nAN02|A541    NLANLLADMR----DRLRPTADD--RLVAVTTVSFDIAALELFLPLVTGAGLVLADRGAA
ORF4_nAD01|A541    QVTALLSWAG----TGVGADRLH--RTVASTSESFDVSVFDTLVPLLTGGRIEIVENTLA
                    :                 . **  :           : *  : :
```

Figure 4b

```
ORF2_nAD01|A541   AG--DELASFLRDRRITT-ALAPAAVLATL--------PPGDLPD---LTDLVTGGFQPP
ORF6_nAD02|A541   AG--QPLADMLAEHRISH-AFIPPAVLSGL--------PSEGLEG---LRCLVVGGEAVT
ORF3_nAD01|A541   ARSPGDLLDLLGRERVTVLSQTPSAFLQLLRAESDLGVPPRTTAA---LRYVVFGGEALD
ORF2_nAD02|A541   G------IARWEKERPAFVKATPSHLALLTEF------GGSTAP-----GTVVLAGEQLI
ORF6_nAD01|A541   P------VLRPGETPPDFVKVTPSHLPVLEGL.------PGEVSPT----GAITFGGEQLT
ORF4_nAD02|A541   ----------AEAHPVDFVKATPSHLPLLERR------PGLLGE----NGTLVLGGEALD
ORF5_nAD02|A541   ----------ARDAGATLVKATPSHLPLLSEL------PGALND----GGTLILGGEALT
ORF2_nAD03|A541   ----------AQDSGVTYVKGTPSHVALLNEL------PGVLDATAERPGTLVLGGEPLT
ORF5_nAD04|A541   E--------RDAPARPDLLKVTPSHLALLDTI------ASWATP----AADLVVGGEQLT
ORF5_nAD01|A541   FD-PPGVVAYFRDRRIDYVDLTPTYFRSLLD-------AGLLEEGFPCPSLVALGGEAMD
ORF5_nAD03|A541   RDPAA-VRSLCAREGVTVIQATPSWWHAMAVD------CGLDLT----ALRVLGGEALP
ORF3_nAN02|A541   RAPEE-LAALLTASGATLLQATPTTWQLLAET------APDALR----GLRKLVGGEALP
ORF4_nAD01|A541   VADR-------TGGEPSLLNAVPSALQALLER------G-EPLA----VHTFLCAGEPFP
                                   *.                                     .**

A5
ORF2_nAD01|A541   PALTARWAP---GR------RMFNVYGPTEATVQATS---GRCA-ADGDRSPDIGNPEAGV
ORF6_nAD02|A541   APLTDRWAP---GR------RMLNIYGPTETTAVTLT---SEAL-TPGGPPPAIGTPVPNT
ORF3_nAD01|A541   TAQLAPWR----GRP---VRLVNMYGITETTVHVTHLELDDAA-VDRGGSP-IGTPLNDL
ORF2_nAD02|A541   GARLDRWRT---RLGASGTTVLNSYGPTETTVNCLEHRIAPDA-DVPSGPVPVGRPVPGV
ORF6_nAD01|A541   GRHLRRWRA---DH--PDVTVYNVYGPTETTVNCSEHRIAPRD-PVGDGPVPIGRPLWNT
ORF4_nAD02|A541   GRALRAWRA---AH--PHAEVVNAYGPTELTVNCAEHRIAAGE-PVPDGPVPIGRPFAGV
ORF5_nAD02|A541   GGRLRPWRE---LH--PDAQVVNAYGPTELTVNCTEYRLPKGE-PVGEGPVPIGRPFACV
ORF2_nAD03|A541   GFMLERWRA---HH--PQARVFNDYGPSETSVNCSDLLLEPGA-EVPEGLLPIGRPLPGN
ORF5_nAD04|A541   ASRLARLRR---AH--PDMRVFNDYGPTEATVSCADFVLEPGD-APPTDTVPIGRPLAGH
ORF5_nAD01|A541   GELWERLRA---AA--PRVTAMNTYGPTETAVDAVVTVLG----DLPPG--TIGRPVPRW
ORF5_nAD03|A541   PALARTLLEPGRAP--LGDYLLNLYGPTETTVWSTVARITADSLEAHGGAVPTGTPIART
ORF3_nAN02|A541   ASLASRLRE-------LGGELVNVYGPTETTIWSTAAHLDR----VTGSAPPIGRALRGT
ORF4_nAD01|A541   APLARSLRA---AF--PRARVANLYGPTETTVFVTAHFLDG----TDDGAPPVGRPLPGV
                              *  **  :*  :        :***       .  :*  *:         *

A6                          A7
ORF2_nAD01|A541   DAYVLDAALRPVPDGVTGELYLRGRGLARGYLGRPGLTAGRFVADPHTGTGERMYRTGDL
ORF6_nAD02|A541   RAHVLDDRLRPVPPGVTGELYLAGASLARGYGRRPALTASRYVGCPFGAPGERMYRTGDL
ORF3_nAD01|A541   RAHVLDQGLLPVPVGVVGELYVAGPGLARGYRRRPGLSATRFVADPFDTGG-RMYRTGDL
ORF2_nAD02|A541   RVLLLDDRLRPVAPGVTGELYVCGPGVARGYRARPAATAERFVACPQGRPGERMYRTGDL
ORF6_nAD01|A541   RLFVLGPGLAPVPVGVPGELYVAGAGLTRGYLRDPGRTAERFVACP-YAAGQRMYRTGDL
ORF4_nAD02|A541   RAMVLDTALAPAPPGVAGELYVTGPGVARGYLGQRALTAERFVACPFGEPGERMYRTGDL
ORF5_nAD02|A541   RVHVLGPGLRPVPAEVPGELYVSGVGVARGYLGRPALTAERFVACPFGEPGERMYRTGDL
ORF2_nAD03|A541   HMFVLDHLLQPVPVGVVGEIYVSGVGVARGYHGRPGLTAERFLPCPYDAPGARMYRTGDL
ORF5_nAD04|A541   RLFVLDDRLRPVPANVPGELYVSGVGVARGYLGRPGMTAERFVACPFGEPGERMYRTGDL
ORF5_nAD01|A541   RAYVLDAGLRPVPPGVLGELYLAGPGVARGYLGQHALTAERFVACPFGKPGERMYRTGDL
ORF5_nAD03|A541   AAYVLDAALRPVPDGVPGELYLAGAGLARGYLGRPGMTAERFVACPFGEPGERMYRTGDL
ORF3_nAN02|A541   RAYVLDEWLNPRPENVPGELYLAGAGVARGYLGRGGLTAERFTADPFGAPGSRMYRTGDL
ORF4_nAD01|A541   RVHILDFWLRPVPDGVVGELYLAGEHVTRGYWQRPATTAERYVADIFGAPGARMYRSGDL
                  :*.   *  *   .  *  **:*: * :   :***     .:*  *:      *  ****:***

A8
ORF2_nAD01|A541   VRRVPGDGRTVLRFVGRADDQVKIRGFRVEPGEVEAAALAELDGVE------QAL--VTVR
ORF6_nAD02|A541   AR-LDREGR--VHHMGRTDEQIKLRGFRVEPGEIRARLTEHPAVR------EAA--VVLR
ORF3_nAD01|A541   VR-RTQDGG--LHYVGRSDSQVKLRGYRIEPGEIEAAARRHPDVA------QAA--TAVH
ORF2_nAD02|A541   MR-WTADGE--LVYEGRADAQVKVRGFRVEPGEVEAALLGLPGVR------EAA--VTLL
ORF6_nAD01|A541   VR-WNEDGL--LEYLGRVDDQISLRGFRVEPGEVEAALAAHPAVR------RAA--VVLR
ORF4_nAD02|A541   VR-RLPGGE--LEYVGRTDEPVKLRGFRIELPEVARTLAADESVA------RAV--VVVR
ORF5_nAD02|A541   VR-WRSDGQ--LEYVGRSDDQVKLRGFRVETAEVARALETCPSVG------SAM--VVLR
ORF2_nAD03|A541   GR-WRPDGI--MECLGRTDDQVKVRGFRVELGEVEAALAARSDVA------RAT--VVVR
ORF5_nAD04|A541   AR-RRADGN--LEYLGRRDGQVKVRGFRVETGEIETALLDRPEIG------QAA--VVLR
ORF5_nAD01|A541   AR-WLPDGH--LVYVGRGDEQVKIRGFRIEPGEVEAALRELEGVA------AAA--VTVR
ORF5_nAD03|A541   AR-WRADGN--LEHLGRTDDQVKVRGFRIELGEVERALTQAHGVG------RAA--AAVH
ORF3_nAN02|A541   VR-RRADGE--LEFLGRTDHQVKVRGFRIELGEIETALGAHPHVAGAVVVARAASGAALV
ORF4_nAD01|A541   GR-LRPDGE--IDLVGRADDQVKVRGHRVELGEVEAALASHPDVL------RAA--AAVH
                   *       *    .  ** * *:.:**.:** *:                 :      *    ..:
```

Figure 4c

```
ORF2_nAD01|A541    EERPG--DRRLVGYLTPAP-----------------------------------------
ORF6_nAD02|A541    DDGPG--GRALVAYAVPAD-----------------------------------------
ORF3_nAD01|A541    GEGPQ--DRYLVCYVVPAA-----------------------------------------
ORF2_nAD02|A541    EGPEGTEGPEGAPGRVAAP-----------------------------------------
ORF6_nAD01|A541    EDTPG--DARLVAYAVPAE-----------------------------------------
ORF4_nAD02|A541    EDRPG--DRRLTGYVVPAA-----------------------------------------
ORF5_nAD02|A541    EDQPG--DQRLVGYLVPAA-----------------------------------------
ORF2_nAD03|A541    EDEPG--DRRLTGYVVPEG-----------------------------------------
ORF5_nAD04|A541    ----G--E-RLLAYVAAPP-----------------------------------------
ORF5_nAD01|A541    EDTPG--TRRLVGYVVGTP-----------------------------------------
ORF5_nAD03|A541    PDAAG--SARLVGYLVPA------------------------------------------
ORF3_nAN02|A541    PDAPA--PRRLVAYVVPEPHRAAPDDGREQNRLDEWREAYDTLYGSSAPAPLGQDFGIWR
ORF4_nAD01|A541    DGKPA--GPRLVGYVVPR------------------------------------------

ORF2_nAD01|A541    ------------------------------------------------------------
ORF6_nAD02|A541    ------------------------------------------------------------
ORF3_nAD01|A541    ------------------------------------------------------------
ORF2_nAD02|A541    ------------------------------------------------------------
ORF6_nAD01|A541    ------------------------------------------------------------
ORF4_nAD02|A541    ------------------------------------------------------------
ORF5_nAD02|A541    ------------------------------------------------------------
ORF2_nAD03|A541    ------------------------------------------------------------
ORF5_nAD04|A541    ------------------------------------------------------------
ORF5_nAD01|A541    ------------------------------------------------------------
ORF5_nAD03|A541    ------------------------------------------------------------
ORF3_nAN02|A541    SSHDGQPIPLDEMHQWRAATVDRIRALRPTRVLEIGVGTGLLLSELAEDCTAYIGTDLSA
ORF4_nAD01|A541    ------------------------------------------------------------
                                                 ^^^^^^^^^
                                                    M1

ORF2_nAD01|A541    ------------------------------------------------------------
ORF6_nAD02|A541    ------------------------------------------------------------
ORF3_nAD01|A541    ------------------------------------------------------------
ORF2_nAD02|A541    ------------------------------------------------------------
ORF6_nAD01|A541    ------------------------------------------------------------
ORF4_nAD02|A541    ------------------------------------------------------------
ORF5_nAD02|A541    ------------------------------------------------------------
ORF2_nAD03|A541    ------------------------------------------------------------
ORF5_nAD04|A541    ------------------------------------------------------------
ORF5_nAD01|A541    ------------------------------------------------------------
ORF5_nAD03|A541    ------------------------------------------------------------
ORF3_nAN02|A541    RAIETLRAQVDAEPALKERVELHVRPAHDFDGLRRGFYDTIVLNSVVQYFPDADHLTRVL
ORF4_nAD01|A541    ------------------------------------------------------------

ORF2_nAD01|A541    ---------GHRG-----------------------------------------------
ORF6_nAD02|A541    ---------GPP------------------------------------------------
ORF3_nAD01|A541    ---------DTD------------------------------------------------
ORF2_nAD02|A541    ---------ARLVG----------------------------------------------
ORF6_nAD01|A541    ---------PEGAR----------------------------------------------
ORF4_nAD02|A541    ---------G--------------------------------------------------
ORF5_nAD02|A541    ---------G--------------------------------------------------
ORF2_nAD03|A541    ---------GP-------------------------------------------------
ORF5_nAD04|A541    ---------E--------------------------------------------------
ORF5_nAD01|A541    ---------DAD------------------------------------------------
ORF5_nAD03|A541    ---------GG-------------------------------------------------
ORF3_nAN02|A541    RGALDLLAPGGRLFVGDVRSLALLRAFRASVETGNSAVSETPAAVLAAADRRTAAENELV
ORF4_nAD01|A541    ---------G--------------------------------------------------
```

Figure 4d

```
ORF2_nAD01|A541    ------------------------------------------------------------
ORF6_nAD02|A541    ------------------------------------------------------------
ORF3_nAD01|A541    ------------------------------------------------------------
ORF2_nAD02|A541    ------------------------------------------------------------
ORF6_nAD01|A541    ------------------------------------------------------------
ORF4_nAD02|A541    ------------------------------------------------------------
ORF5_nAD02|A541    ------------------------------------------------------------
ORF2_nAD03|A541    ------------------------------------------------------------
ORF5_nAD04|A541    ------------------------------------------------------------
ORF5_nAD01|A541    ------------------------------------------------------------
ORF5_nAD03|A541    ------------------------------------------------------------
ORF3_nAN02|A541    IAPDYFARLRREAREPLLLDVRIRRGRPYNELTRYRYDVLLVKQETGAAPSALPPATELR
ORF4_nAD01|A541    ------------------------------------------------------------
                                               ^^^^^^^^^^
                                                   M2

ORF2_nAD01|A541    --------------------SLDVERLRRV-LA---------------------------
ORF6_nAD02|A541    --------------------RPTAAQLRAH-LN---------------------------
ORF3_nAD01|A541    --------------------PDPHQVRAH-LA----------------------------
ORF2_nAD02|A541    --------------------YVVGASEEPAALLER-LR----------------------
ORF6_nAD01|A541    --------------------STPPSPLPTEQILEH-LR----------------------
ORF4_nAD02|A541    --------------------VRPHEDELR-GA-VA-------------------------
ORF5_nAD02|A541    --------------------SGALDKEAVSDA-VR-------------------------
ORF2_nAD03|A541    --------------------DADFDPAAALRD-LA-------------------------
ORF5_nAD04|A541    --------------------RFDPDALRQA-LA---------------------------
ORF5_nAD01|A541    --------------------DARLRPAEVLAR-LR-------------------------
ORF5_nAD03|A541    --------------------SGALDEKAVADA-VR-------------------------
ORF3_nAN02|A541    WTPETGDAGRLAEICAAHPGALRVTAIPNARVRRETTALAALEDGRPVTEVRRLLEQPGD
ORF4_nAD01|A541    --------------------PAPDTAAVLDH-VR--------------------------
                                                  :

ORF2_nAD01|A541    ------------------------------------------------------------
ORF6_nAD02|A541    ------------------------------------------------------------
ORF3_nAD01|A541    ------------------------------------------------------------
ORF2_nAD02|A541    ------------------------------------------------------------
ORF6_nAD01|A541    ------------------------------------------------------------
ORF4_nAD02|A541    ------------------------------------------------------------
ORF5_nAD02|A541    ------------------------------------------------------------
ORF2_nAD03|A541    ------------------------------------------------------------
ORF5_nAD04|A541    ------------------------------------------------------------
ORF5_nAD01|A541    ------------------------------------------------------------
ORF5_nAD03|A541    ------------------------------------------------------------
ORF3_nAN02|A541    GVDPEDLYDAATAAGRTAWVTWSADGPPDTVDLVLAPAGGDGVPPVAPPAELWPGAPAAD
ORF4_nAD01|A541    ------------------------------------------------------------

A9             A10
ORF2_nAD01|A541    -------------------DRLPAHLVPSLLMELA-EIP-RTANGKVDRAALPD
ORF6_nAD02|A541    -------------------ALLPPYMVPAAFLVLD-ALP-TTPNGKLDREALPA
ORF3_nAD01|A541    -------------------DALPGYMVPAAVVPLT-ALP-LTPNGKLDRAALPA
ORF2_nAD02|A541    -------------------VRLPDHMVPAALVDLD-ALP-LTPNGKLDRRALPA
ORF6_nAD01|A541    -------------------RTLPPYMVPAHLVELP-ALP-VTPHGKIDRAALPE
ORF4_nAD02|A541    -------------------RTLPDYMVPSAVVVLD-ELP-TTPHGKLDRRALPA
ORF5_nAD02|A541    -------------------AVLPEYMVPSALVVLE-DGPPLTVNGKVDRSALPA
ORF2_nAD03|A541    -------------------AALPPYMVPAAIVVLS-ELP-RTENGKLDRRALPA
ORF5_nAD04|A541    -------------------SRLPRYMVPAAFVRLD-ALP-LAPGGKLDHRALPE
ORF5_nAD01|A541    -------------------DRLPDHLVPSAFVRLR-ELP-VNTSGKLDRAALPA
ORF5_nAD03|A541    -------------------AVLPAYMVPSALVVLDGGLP-LTANGKLDRAALPA
ORF3_nAN02|A541    RPETNDPTAGSHHRELAARLRSHLAERLPDYMVPSAVVVLD-ALP-LTANGKVDRNALPD
ORF4_nAD01|A541    -------------------REVPPYMVPSALVVLD-ELP-LTVNGKRDRAALPP
                                        :* ::**: .: *    *     ** *: ***
```

Figure 4e

```
ORF2_nAD01|A541      P--APLAPTAGRAPRD---
ORF6_nAD02|A541      P--QPHAEETGRPPRD---
ORF3_nAD01|A541      P--DRAAWATGGAPTGPRE
ORF2_nAD02|A541      P-DFGRHA-GRRAPSG---
ORF6_nAD01|A541      P-SVAGAP-AGGAPRS---
ORF4_nAD02|A541      P-AHRSR--GGRPPRD---
ORF5_nAD02|A541      P-EAEPARSAGRAPRG---
ORF2_nAD03|A541      P-DYGTAS-VGRAPRT---
ORF5_nAD04|A541      PPAPADAPHGSRPPRD---
ORF5_nAD01|A541      P-DPADFP-AGRRPRT---
ORF5_nAD03|A541      P-EATTGRGPGRAPRG---
ORF3_nAN02|A541      P-DP-AGTDAGRPPR----
ORF4_nAD01|A541      P-PDRSDTTRARAPRG---
                     *                *
```

Figure 5

```
ORF2_nTD03|A541    -ETDLCALFADVLGVPGITLDDDFFALGGHSLLAVRLACRIRAELCLRLDIRTIFDHRTV
ORF4_nTD02|A541    -ERDLCRIYADVLGLPEVGAEDDFFALGGHSLLATRLVNRIRAELAEELDVRTVFEARTV
ORF3_nTD01|A541    -EEALCAAFADVLGVQEVSRDADFFALGGHSLSAVRLISRIRSALGVEIGIRTLFEAPTP
ORF4_nTD01|A541    -ETILLGLFAEVLGVRPVGIDDDFFALGGHSLLATRLVSRVRTTLGAELAVRDLFEHPTV
ORF6_nTD01|A541    -EEILCGIFAEVLRRPRVSIDDDFFALGGHSLLATRLASRVRAALDTELPVRRLFEHPTV
ORF5_nTD03|A541    -EEILCGLFADVLGVPAVGVDDDFFALGGHSLLATRLTARVRGTLGVELGVREVFETPTV
ORF5_nTD02|A541    -EEILCGLFADVLGVRAVGVDDDFFALGGHSLLAIVVISRIRALLDVDVAIDALFEAPTV
ORF2_nTD01|A541    -EEALCALFAEVLGVEEVGVDLDFFALGGDSLLAARLASRIRGRLGKAVTVREVFRSPTV
ORF6_nTD02|A541    -EAALCEVFAEVLERTSLGADDGFFENGGHSLLAVRLVARVRERLGVPLAARDLFEAPTP
ORF5_nTD01|A541    -EREVCALFAEVLCACSVGIDDDFFGRGGDSILSIQLVGSAR-RAGLTFTVRQVFELRTP
ORF5_nTD04|A541    WEGVLCEAFGEVLGIAEVGADDDFFALGGDSIGSIRLVGRVR-AAGGRMTVRDIFEQRTP
ORF2_nTD02|A541    -EEALCALFADVLGVPEVGADDSFFTLGGDSIVSIQLVGRAR-GAGLHLTVRDVFEHPTA
ORF3_nTD02|A541    -EELLCTLFADLLGLGRVGVQDSFFGLGGDSVLSVRLVSRAR-AHGLPLTTRDVFEHHTA
                    *   :   :.::*      :  :  .**  **.:*:  :   :     *   .   :*   *

ORF2_nTD03|A541    ADLLADP----
ORF4_nTD02|A541    AALAARLRT--
ORF3_nTD01|A541    AALSRRLDTA-
ORF4_nTD01|A541    AGLYARIARA-
ORF6_nTD01|A541    RSLSALLDPD-
ORF5_nTD03|A541    AGLAAALSAA-
ORF5_nTD02|A541    ARLAAHLDGP-
ORF2_nTD01|A541    ARLAEELGDG-
ORF6_nTD02|A541    AALAERLARG-
ORF5_nTD01|A541    AALAAAARRT-
ORF5_nTD04|A541    AALAGRSRPGG
ORF2_nTD02|A541    AGLATVVRSA-
ORF3_nTD02|A541    AALAAALDG--
                    *
```

Figure 6

```
                                    E1
ORF5_nED01|A541    AAGDEDPALAVGPLPLLPVVAETLAAGG-----PVHSYNQSVVLASPPDAAPDDVRDALQ
ORF5_nED04|A541    PATEVLGGRGTGPVEPTPISSWLAELGG-----AVDGYNQSVLLRVPAEADAAVVTGALQ
ORF2_nED02|A541    ERPAPQALAPSGTLPYVPAAARLVARTGSMRARGADRFHQSVVLTTPANAAADDVRRVLQ
                    *.:   *   :      *       .. ::***:*  *..:*   *   .**

ORF5_nED01|A541    ALLDRHDALRVHAAPAAGPGRLWDLRVEEAGTVAAERCLRRIDATGMSDEELARAQAAEA
ORF5_nED04|A541    TLLDHHDALRMRAEPEDG---HWRMEIAEAGAVDAATVLERVDAAGADQGELDRLVRTHC
ORF2_nED02|A541    TLIDHHGALRLRTAADRD-GSPDGLVITEPGTVAAAGLLRCRDAAGLQGVALREAVEREA
                   :*:*:*.***:::  .    : : *.*:* *  *. **:*  . *  .      ..

E2
ORF5_nED01|A541    VTARACLDPLAGALVSAVWFDRGDR-PGRLVLVIHHLAVDGVSWRILLGDLREAWR-ALR
ORF5_nED04|A541    AAAARDRLAPQKGSVLRAVWFDGGPREPGHLALVAHHLVVDGVSWRILTADLGSAWQ-ALA
ORF2_nED02|A541    GHARDALDPSTGAVLRAAWLDRGKDRLGLLVLVAHHLSVDGVSWRILADDLRQAWTPADA
                    **  *  *  *::: *.*:* *    * *.** *** ********  ** .** *

ORF5_nED01|A541    AGRRPELPRTGTSLRTWATRLTERATDPAVTAQLDHWTATLADGPAPGS------RPLDR
ORF5_nED04|A541    EGREPHLDPVGTPLRIWARHLAELAADPRRAERCAHWEEQSPRPWETGG--------LDP
ORF2_nED02|A541    PATTATLPPEGASLREWATRIARRATETAVTGRLPHWRATLAGLDDPDGDVVALETRLDP
                    .  *   *:.** ** :::. *::.  : :  **    .  ...            **

E3
ORF5_nED01|A541    TRDTVATSAVLSGELPASLTTDLLGPAPAAFRAGVNDLLLTAFALAVAHWRGEEDAP-VL
ORF5_nED04|A541    ALDDRSTEEALSLTLPAAATRAVLGPVPAALGVGVSEVLLGTFAAAVRRRRPAEAADGVT
ORF2_nED02|A541    EADTHGTAREHAHGLSPDLTDALVRTAPAALRADTGELLLAAYALAAS--RTLGDRPVFV
                    *  .*      : *..  *    :: ..***: ....:.** ::* *.  *

E4          E5
ORF5_nED01|A541    VDLESHGRTEELVPGADLSRTVGWFTSVHPVRLAAGRVTAADLAERAPAVGDAIKRIKEQ
ORF5_nED04|A541    VDLEGHGREEDVVPGADLSRTVGWFTAAHPVRVPAARPDE----DRT----GALRALAAI
ORF2_nED02|A541    AETESHGRQDALLPGVDLTRTVGWFTSVHPVRLRPGAGAER-----L-------LKETKER
                    .: *.***  :  **.**:.**.**:*******:.****: ..                 ::

E6                           E7
ORF5_nED01|A541    LRAVPDGGLGHGLLRHLNPDTAPRLRG--LARARFGFNYLGRF---AAEQGAGED---SW
ORF5_nED04|A541    LDRAPDAGLGYGLLRYLNPRTRQRLAA--LPAPRYGFNYLGRFG-GSGEDRDADDRTSNW
ORF2_nED02|A541    LRTVPEAGLGHDLLRLGGAASSPRESGRELPRPQFGFNYLGRVAVAEALTDEGTEPAGAW
                    *  .*:.***:.***   ..   :   *   .  *. .:.:*******.       . :      *

ORF5_nED01|A541    PLLGSGPAGQHPDTPLDHEIEVNVVTAEGPDGPRLITRWTYATGLLTEEEVRRLTRSWSL
ORF5_nED04|A541    SPVAAGLAGQPAQLPLAHEIEVTAVAVEGPEGPRLIATWSWAGRLHRERDVRELAELWFR
ORF2_nED02|A541    AFAGHSLTAQPPELPLTHEVELTVVLEDGPRGPVLRARWNASARCLTGARLTALAQEWEK
                    .  . ..:.*  .: ** **:*:..* :** ** * :*.  :      : *:. *

ORF5_nED01|A541    ALHAVVGHATAEGAGGLSPSDVAVPDLGQAEIEQLERRTGTAL
ORF5_nED04|A541    ELEELASAEPPPAGPAPLSDPPPLVELTDTELDQLEAEWKAG-
ORF2_nED02|A541    ALHELTALAGVAGTAGLIPSETGAGDLDQDAIEECEAAADFEV
                    *. :..     .  ..  :* :   :::  *
```

Figure 7

```
ORF6_nTE02      |A541       GLGWAYASLLPWLPADVPLHALQARTPADGAG-LPGSVEEMAEDYVRLIRRVRPHGPYRL
CAD55498_nTE02|CADA         GMSWCYSGLVRHLPPGIPVYGLQAAG--LDGDGPLPATLQEMAAEYADLVRQTQPEGPYRL
                            *:.*.*:.*:  **...:*::.***    ** * **.:::*** :*. *:*:.:*.*****

Te
ORF6_nTE02      |A541       LGWSLGAHVAHTAAALLERDGQRVDLLAMLDAYPPHRTGDPGGRAEESEAEIVAANLRES
CAD55498_nTE02|CADA         LGWSLGGNVAFAMARELRARGQEVELLAFLDAYP-RRAG---AGPEAPLAEVFAHNLRDA
                            ******..**.: *  *.  **.*:***:***** :*:*      . .* . **:.* ***::

ORF6_nTE02      |A541       GFAWDEDEQRAGRFPLERFRAHLRRVDSSLGHLDDAELTAAKDVYVNNVRLMRSFTPGRV
CAD55498_nTE02|CADA         GFDVAEEELTGGRFPTARYRAFLNAAGDPMGRLDEAELAAVLEVFMNNAALMRGHTPGTY
                            **    *:*    .****   *:**.*.   ...:*:**:***:*.  .*::**. ***..***

ORF6_nTE02      |A541       RCGIVLMTAERTRS-----LDPAAWEPHTEGGVEVHRLDASHMSMLTEPASVAAAGRLLT
CAD55498_nTE02|CADA         DGDVLVLAAERADGDKLARRGAESWRPHVRGRIERVGVDADHLGLVQSDAALAVIGRALA
                            .::::::***: .       .. :*.**..* :*   :**.*:..:: .  *::*.  ** *:

ORF6_nTE02      |A541       HRLESLRG----ATTKKRE----
CAD55498_nTE02|CADA         GRLDPATGHAASAAVPETEGVTA
                            **:.  *      *:.. :  *
```

Figure 8a

```
                              C1                                              C2
ORF6_nCD02|024A    EDVLPVAPLQEGLLYHSVYD-RRALDVYVGQLAFRLDGEIDEDALRAAAGVLVARHTSLR
ORF4_nCD03|024A    ADLLALAPAQEGLLFHSTFD-DEAEDVYVGQLALELHGELSGARLREAAQGVLDRHDALR
ORF5_nCD01|024A    EEVLPVTPLQEGLLFHAVFD-EDVPDAYVSRLVLALRGDLDAGRLRRAAQALVGRHPALR
ORF7_nCD01|024A    QDVLPLSPLQEGLLFHSEYAGDEAVDVYTVQTEVELHGPLDVPALRAAAEALLRRHDNLR
ORF6_nCD01|024A    --MLPLSLAQQRLWFLHQMD--GPSATYNIPTALRMTGALDVAALREALRDVVRRHETLR
ORF4_nCD05|024A    PHRVPLSSAQRRLWFLGELE--GPGATYNIPLALRLRGPLDVGALRAALADVVARHEALR
ORF6_nCD03|024A    PGRLPLSYAQQRLWFLHQIE--GPSATYTVPLALRLTGPLDVAALRAALADVVARHESLR
ORF6_nCD04|024A    PGRLPLSYAQQRLWFVQQLE--GPGATYNIPLALRLTGPLDVAALRAALADVVARHASLR
ORF7_nCD02|024A    PERVPLSYAQQRLWTLHRLT--GPDATYNIHRALRLDGDLDVRALEAALHDVAERHETLR
ORF5_nCD02|024A    PGRIPLSFAQRRLWFLHRLQ--GGSAAYHVPLALRLTGRLDTAALRGAIADVVAGHGSLR
ORF4_nCD04|024A    PERLPLSPAQRRLWFLNRYD--REAGGYHISVALRLTGDLDVGALHAALGDLAARHESLR
ORF4_nCD02|024A    PERVPLSAAQRRLWFIDELQ--GASAAYNIPTTLRFDGPLDVPALHAALGDVVDRHEALR
ORF4_nCD01|024A    ADRVAATSAQSGIWTAQRLR--SDDRLYTCGLYLELD-HVVEEVLGEAIGRAVADTEALR
                    :  :      *   :    *          . :   :    *   *       **

C2
ORF6_nCD02|024A    TGFQQRES------GQWVQTVAAAAELPWRSCDLRALEDAPGDAGAAQRRLDELAAAERT
ORF4_nCD03|024A    AAFLQRRS------GEWIQAIAARAPVGWEEHDLS----GPGGQ-ERQRRLEELLAGQRT
ORF5_nCD01|024A    SAFRQRRS------GEWFQLVASRPAVPWEELDLR----SAGGPAEADKHLEALLDEHHR
ORF7_nCD01|024A    AGFATRAL------KDPVQFVPREVELPWEEADLR----AAGDP---EAEAARRLDEHRW
ORF6_nCD01|024A    TVFPDAGD------GARQHVLPAAEA-AVELTVTG--------TTEAELPAVLAQEAG
ORF4_nCD05|024A    TVFPAENG------VPHQHVVAPEEA-APGPAVVD---------VAEEELPAALAEACA
ORF6_nCD03|024A    TVFAEDEH------GPHQIVLGPRQG-APGLQVVP---------TTEARLRADLEAEAA
ORF6_nCD04|024A    TVFAEDEH------GPHQIVLAAADGPAPLAGPVR---------TDEEELPRLLREAAD
ORF7_nCD02|024A    TVIAEGAE------GPFQKVLPARRT-DERLTVLP---------AAEEEVDRTVGELAA
ORF5_nCD02|024A    TSFHEDAE------GPHQVVRDAAEA-AELITLVP---------EPVDDPLRAADEAVA
ORF4_nCD04|024A    TVFREDEE------GPYQVVLPAAPS--PAPAAVP---------ASARELDALVREAVR
ORF4_nCD02|024A    TTVRPAAEDATGAAAAPEQHIAPPGGH-RLPLPVRD---------IAPEELAGELRAAAG
ORF4_nCD01|024A    TAFGEDGD------GALEQRVLARPPDTQTRLFRLDLG----GDDRPRAEALDWMDRQQA
                    :                *  :

C3
ORF6_nCD02|024A    ERFDLTRPPLVRFLLARTA-----------------PEQYRFVITTHHHTIVDGWSIPILL
ORF4_nCD03|024A    RRFDLSRPPLVRFLLVRTA-----------------ADRHVLALTNHHLVLDGWSLPLVV
ORF5_nCD01|024A    TGFDLGRPPLLRFLLARTG-----------------EDRHRLAVTYHHIIILDGWSMPILM
ORF7_nCD01|024A    RRFRPAKPPLVRFLLLRTA-----------------QDRHRFALTNHHILLDGWSMPVLL
ORF6_nCD01|024A    HAFDLAREVPLRARLLALG-----------------ERDHVLCLVIHHIASDGWSRAPLA
ORF4_nCD05|024A    YAFTLTEDLPLRAVLLRTG-----------------PTDHVLSLVLHHIAGDGWSLAPLA
ORF6_nCD03|024A    RPFDLAQAPPVHARLFALD-----------------ERTHVLLLAVHHIAMDGWSVRPLV
ORF6_nCD04|024A    HEFRLDAEPPLRTHLFATA-----------------PDEHVLLLVMHHIATDAWSQRPLI
ORF7_nCD02|024A    HRFDLEAEPPMRAWLLETG-----------------PHSRVLVLVLHHIASDGWSGRRLL
ORF5_nCD02|024A    EPFDLTAGLPLRCRLFTRTGTPRAPRDPAEPPAGGEPEEHLLLLVVHHIAADGWSLRIIA
ORF4_nCD04|024A    RPFDLAEDTPLRHTLFALP-----------------DREHVLLLVIHHIAADGWSMGPLA
ORF4_nCD02|024A    HVFDLTRDLPVRARLYRTA-----------------EREHVLLLLVHHIAADGASMGPLI
ORF4_nCD01|024A    EPWDLAAGDTCRHTLIRLG-----------------GHRTVLHLRYHHLALDGFGAALYL
                    :        :    *                        : : ** *. .

C4
ORF6_nCD02|024A    RELLALY---GG-APLPDAPGHRAYADWLAGRDL-----------RAAREAWTRALEGV
ORF4_nCD03|024A    RDLMALYGADGG-AALPAARPYRDYLAWLGGQDR-----------DAAREAWTRALAGL
ORF5_nCD01|024A    RELVALYGSGGDPSALRPVRPHRDHLDWLARRPS-----------ERSAHAWRQALAGL
ORF7_nCD01|024A    RELMLLYRTGGDASALPPVRRYRDYLAWLDRRDE-----------RAAQDAWRRALEGL
ORF6_nCD01|024A    RDLTTAYAARSEGRAPQWEELPVQYADYTLWQRELLGSEEDPESLLSRQTAYWKQALAGL
ORF4_nCD05|024A    RDLSTAYAARLEGRAPRWRPLPVQYADFTLWKERLLGEADDPDSLFARQLAFWRDTLAGA
ORF6_nCD03|024A    RDLAAAYAARRRGAPPALPELPVQYADYTLWQHEELGTEDDPDSAIAAQLRYWRDALRGL
ORF6_nCD04|024A    ADLAAAYAARRAGRAPAWPPLPVEYPDYALWQRARLGDEREAGSELAAQLAYWRDALAGS
ORF7_nCD02|024A    RDLFTAYTARRAGRAPNWRPLPVQYVDYALWQRRFLGDPADPGSTAAAQLEYWERQLAGL
ORF5_nCD02|024A    RDVAAAYAARVDGRRPAPAPPPVDYVDHTLWQHRVLGGPDEEGGPLGEQLAYWRRQLAAL
ORF4_nCD04|024A    RDLAAAYRARAAGDAPRWPAPAPSHADHVLRRHRAPEHGGDAGDPADHRLAHWAEELRGL
ORF4_nCD02|024A    GDLATAYTARLAGRAPDLPAPEVTYADFALWEHR----GGEHAAAQAEGLDYWRRALAGL
ORF4_nCD01|024A    DRIAAVYRALRTGRETPPCTFAPLARLVEEDRAYR------RSARHRRDADHWRTRFADL
                    :  *                             .              *    :
```

Figure 8b

```
ORF6_nCD02|024A    GGPTLVAPGAPRVGEIP---ESVRLNLPEDVSARLRTRAREAGVTLNSVVQAAWALVLAQ
ORF4_nCD03|024A    Q-PSLIAPNARRDGAAP---LPHYRTMDPQVVSRLTAWARRHGVTLNSAVEAAWALLLGR
ORF5_nCD01|024A    SGPTLVAPGADRNGPLP---QQVWTRLTERDTRALTAWARARGVTVNSAVQAAWATVLGR
ORF7_nCD01|024A    EAPILVAPRADRAAEAP---QWLDFELPAAASAGLTRAARGAGLTLNTVVQGLWALTLAR
ORF6_nCD01|024A    PDAIELPFDRPRPPIAGHRGDTVPITLPPRTHERIAALAGRHGASTFMVVQAALAGLLSR
ORF4_nCD05|024A    PEQIELPTDRPRPAMESHRGAIHRFTLPARLRDRLRALAHSRQATLFMALQAGLAALFAK
ORF6_nCD03|024A    PEELALPADRPRPATPSHRGGRVGFTVPPAVHGRVAELAREHRATPFMVVHAALAALLTR
ORF6_nCD04|024A    PEELALPADRPRPAIPSHRGDSVPILVPPAVHGRVAELAREHRATPFMVVHAALAALLTR
ORF7_nCD02|024A    PEELRLPADRPRPAVPSRTGGQVWLTLPASVHTAVVDLARTCRASVFMVVQAAVAAFLTR
ORF5_nCD02|024A    PPELALPADRPRPAVSSHRGEDLDFAVPAAAAARMRELAGTTGTTPFMVLQAALAVLLHR
ORF4_nCD04|024A    PDELPLPYDRPRPTTPPGYAERIGFRIDAGLYRDVLALAARHRATPFMVLHAALAALLTR
ORF4_nCD02|024A    PDRIRLPADRPRSQEPVRRGGAARFEVPPALYARLAELAGSVRATPFMVLQTAVAVLLSR
ORF4_nCD01|024A    PRPTSLAGAAAPAAPAALR---HTVRVSAADTAALGLRADRSGSTWPVFATAAVAAFLSR
                     :.              :        :  *       :        *  :  :

C5                    C6
ORF6_nCD02|024A    ETGRDDVTFGITVSGRPAELPGAEDMVGMLVNKIPLRVRLRPAEPLLELVRRLEKEQLEL
ORF4_nCD03|024A    LTGRDDVSFGIAASGRPTDLPGAAEIVGLLMNTVPVRVVLDPGEPLEALVRRVQREQAGL
ORF5_nCD01|024A    LTGRDDVVFGTTVSGRPPELPGAEDMVGFFINTVPLRVRMRPDEPIGDLVARIQREQTAL
ORF7_nCD01|024A    TTGSQDVVYGVVVSGRPPELDGVESMVGLFANTVPLRARMPAAEPLTDFLRRLQREQSAL
ORF6_nCD01|024A    LGAGTDIPLGTSVAGRTD--EALEGLIGFFVNTLVLRTDTSGNPTFDELVARARETALDA
ORF4_nCD05|024A    LGAGRDIVLGTPVAGRGD--EAVDDLVGFFVNTLALRTDLGGDPTFEELLDRVREADLSA
ORF6_nCD03|024A    LGAGTDVPIGSPVAGRTD--DALEDLVGFFVNTLVLRTDTSGDPSFAELLERVRATDLAA
ORF6_nCD04|024A    LGAGTDVPIGSPVAGRTD--DALEDLVGFFVNTLVLRTDTSGDPSFAELLERVRATDLAA
ORF7_nCD02|024A    MGAGEDIPVGTPVAGRTD--EAVEDLVGFFVNTLVLRTDTSGDPAFAELVGRVRETALAA
ORF5_nCD02|024A    MGAGTDIPVGTPVAGRTD--GAVEGVVGLFVNTLVLRTDLSGSPTFRQLLDRVRSTALDA
ORF4_nCD04|024A    LGAGTDIPVGTPSAGRDR--PETADLVGFLVNTLVLRTDTSGDPTFGELLDRVRETDLRA
ORF4_nCD02|024A    MGAGPDVPLGTPVAGRPD--EALDEVVGCFVNTVVLRTDVSGDPTVAELLARTRDGDLAA
ORF4_nCD01|024A    LAPGEEVVVGFPVTARVT--PAAVRTPGMLANVVPLRIRVRQGMSFAALLDRTAAEIGAT
                    ::    *      :.*      .*  :* : :*          .. :: *

C7
ORF6_nCD02|024A    LEHQHVPLTALHRWS-GLPE------LFDTTMVFENYP----AEITA-REAP---FRASG
ORF4_nCD03|024A    LDHQFVPLAQVQRWV-GGGD------LFDTTLVFENYPLDPAAGLTA-GEAGGDGPRLHD
ORF5_nCD01|024A    MEHQHVRLSDIQRWS-GQAE------LFDTSTAFENYPADDLAAVGS-SDHAG--LRVEG
ORF7_nCD01|024A    LDHQHVRLADIQRLV-GQGE------LFDSVMAFENYPAGPAEEPPGDSPAAPGRVRAVA
ORF6_nCD01|024A    YAHQDVPFERLVEAL-APERSLARHPLFQVSLSLQHATEQTAVLD-----GLEIAPLDTG
ORF4_nCD05|024A    FAHQDIPFEQLVEAL-NPTRSLSRHPVFQVLLALQNNELGEAVMP-----GLEVTVERPA
ORF6_nCD03|024A    YAHQDLPFERLVEVL-NPVRSLARHPLFQVLLAFNNGAVP-ADGPADRASDVLVRPVTVE
ORF6_nCD04|024A    YAHQDLPFERLVELR-DPERSLARHPLFQVALNFDTAETAGARDTAPELDGLTVRRERLG
ORF7_nCD02|024A    YAHQDLPFEQLVERL-SPARSLGRHPLFQVALSCNNTEEQLGRQGSPPP-GLAVSPHQVE
ORF5_nCD02|024A    YAHQDVPFERLVEAL-APERSLARHPLFQVSLALQNLDDAAAPAG--ELPGLRAEAVRTR
ORF4_nCD04|024A    YTHQDVPFERLVEVL-NPARSPSRHPLFQVTMLTLDN-AAQGALEHLLDLPGVRAELLPTA
ORF4_nCD02|024A    LAHQDVPFDRVVDAV-NPVRSIARHPLFQVMLVLNGAEQRRGRAR---FPGLDSRIGAVD
ORF4_nCD01|024A    LRHQRHRTEDIGRALGLPPHGAQPAPTLVNVMAFAPVLDFGDCLS----------PVHQL
                     **        :              .                    :

ORF6_nCD02|024A    TAGYSRNHYPVTLVG----AMRGSELTVRIDYRPDLFGEDWARSLGRRVVAALTEAADRP
ORF4_nCD03|024A    ARGHDSNHYPLSVT-----VGPAPDLQLRFTYRPDLFAPEWVEELAARFEQVLDTMAASG
ORF5_nCD01|024A    GSGVTTNHFPLSLY-----ALPGPALRLRLDHRPDAVDHDTARRAADLLGRALAAVLGAP
ORF7_nCD01|024A    SRMRDAMHYPLGLL-----ASPGPPVRFRLGHRPSAVTPDRLAAALRDRLLRLVDAFLAAP
ORF6_nCD01|024A    WRAAKFDLSFDLLEK-HGPGGRPDGITGTVEYSTDVFDAGTVARLAERYQDLLLAVTEEP
ORF4_nCD05|024A    QVAAKYDLFVNLVES-RDPAGGATAIEGAVEYATDLFDAGTVARLAERYQDLLLAVTEEP
ORF6_nCD03|024A    TAAAKFDLSLSFNED-RAADGSAAGIRGVLEYSTDLFDESTAHRTVRYFLRLLGAAVEQP
ORF6_nCD04|024A    VTTSKFDLTFALTET-RTRDGGAGGLRGVLEYSTDLFDRSTARHLVERLGRVLEAVVEAP
ORF7_nCD02|024A    TARSKFDLMFTFLEG-HGEDGRPAGIETALEYSADLFDRETAQDLLEAFGRMLALWAADP
ORF5_nCD02|024A    RDGAKFDLSFVLAPG-GPEGG---DMPGVLTYSTDLFDRATAQGLVDRLLRVLDEVLAAP
ORF4_nCD04|024A    EGTAHTDLDLTFAETGSAPPAGGTGLDGTLQYRPDLFDRATAQALVERFVALLRTVTREP
ORF4_nCD02|024A    SGETKFDLSWHFTHR----DGPERALEGTLVYAADMFGAATARRLTERLLGVLTAMADDP
ORF4_nCD01|024A    SAGPVEDLAVNLLGT----PGDGRELEITVAANPLLHSEDAVASLAARLAEFLARAGEHA
                                           :     .    .               :
```

Figure 8c

```
ORF6_nCD02|024A        AAPSGTLDLLDGEERARLLEDW-
ORF4_nCD03|024A        TTPAGRLGVLLPHERATLLGDW-
ORF5_nCD01|024A        ATPTAAVAAPRQAPRPRER----
ORF7_nCD01|024A        DLPLGRLDVLDDAERALVLEKF-
ORF6_nCD01|024A        GARLLSVDLLSAGERRRLLAEF-
ORF4_nCD05|024A        ATRLSRIPVLSGAERGMLAAEW-
ORF6_nCD03|024A        RTPLSGLPVLSEPERHELLVRR-
ORF6_nCD04|024A        GTALGEIDVLLPGER-ELLAGAW
ORF7_nCD02|024A        GGPIGARELLAADERHTVVAEW-
ORF5_nCD02|024A        ATPVGKVDVLLPGEAQRALEHG-
ORF4_nCD04|024A        GLRLGRLDVTTGEERRRLVEE--
ORF4_nCD02|024A        GRPVGSIDVLSAAEHRAVRAW--
ORF4_nCD01|024A        DAPIGRTRLLGAA----------
```

Figure 9a

```
                             A1
ORF6_nAD02|024A    DAPAVTSPGG---TLTYAELDRQANGVARWLADRTAGTGGAEVYVGVLAPRRAEALAVLL
ORF5_nAD02|024A    DAPALRWNGG---RLTYAELDRRAGAVARVLLGRGIGP---EDVVAVAAPRRPEVVAALL
ORF4_nAD03|024A    DALALVEGGDGGLRLTYAEFDARANRMARFLTARGIGA---EDLVGLVFPRGADLLTGLW
ORF6_nAD04|024A    HAPAVRDGGR---EVAYAELNSRANRLARLLAGRGAGP---EDTVAVLLPRGAGLITALV
ORF4_nAD02|024A    GAPAVTEPGR---VWTYAELDARANRLARALAARGVGA---EDLVAVLLPRGADLVATLL
ORF7_nAD01|024A    GRTAVETADR---SIGYGRLADRSGRLARLLVERGARA---ERFVALALPRSPELVEAAL
ORF4_nAD01|024A    DAPAVASDRT---TWTYARLDAHAGRVARRLAARGVGP---ESIVALAVPRGVELAALVI
ORF7_nAD02|024A    DAPAVEHAGR---GLTYAELNARANRLARVLVRHGVGP---ERRVALLMPRSLGQVTALL
ORF6_nAD01|024A    EAVAVVGGDT---ALTFAEADARVSRLARLLISRGAGP---ETRVAVCLGRNALWPTAVL
ORF4_nAD04|024A    SAPALTDGGT---TVDYAELDARSNRLARALLELGVGP---EDFVALAVPRSADLVAVL
ORF6_nAD03|024A    RATALVAGEE---RICYADLDARADRLAGLLSDGAAGR---SGPVAVALRRGALLPVTLL
ORF4_nAN05|024A    ----------------------------------P---ERRVAVCLPRTADLVACLL
ORF5_nAD01|024A    GAPAVLAGGR---ELTYAELDARANRLARLLISRGVGP---ESRVALTVSRNAWLPVAVL
                                                          *.:   *

A2
ORF6_nAD02|024A    GVLKSGAAYVPLDEQWPAERTRRVLEDCRPALVVAPAGSRPDGVR-------EAGAEVLA
ORF5_nAD02|024A    GVLKSGAAYLPVDEAWPAERRRQVTADAGARLLLAPGSTDAARAA-------LAPPTGPG
ORF4_nAD03|024A    GALKAGAAYLPVDVDYPAERIGLLLSDGAPALVLTTSAHAHLVPE-------APGRQILC
ORF6_nAD04|024A    AVQKAGAAYVPLDAELPTGRIAHMLDDAKPVLTVTDGAHRGTLPG-------GAG-PVVC
ORF4_nAD02|024A    GVLRAGASYLPLDTGHPSDRNRWAVSDAAPALVVTDGAHRGTLPG-------ETGCAVLV
ORF7_nAD01|024A    AVWQTGAAYVPVDPGHPADRVARLLREAEPLLTVTTADLAGRLPA-------DLP--LLV
ORF4_nAD01|024A    GVQRAGGAYLPIDPEYPAERIGFLLRDARPALVVCEPGTDLPDTG------CPQVPAGDL
ORF7_nAD02|024A    AVLKAGGAYVPVDPGHPEERIAFMLRDSAPALVLAAESCAAGRGE------IAGVPV-LV
ORF6_nAD01|024A    AVLRSGAAYVPLDPRSPAERLAAVERDATPLIVLAERGTEAAVAG------LTAPLL--V
ORF4_nAD04|024A    AVLKSGAAYLAVDPDYPAERTSYILGDCRPAAVLSTTAVRAALHGTVG--EAAGEVPWLL
ORF6_nAD03|024A    AVWKAGLHYLPLDPGHPRERLADVLADCAPACVVTTADLAGD---------LPPGPAPLLV
ORF4_nAN05|024A    GVLRAGAAYVPLDPEYPDERIAAILSDTRPVALLTTADCR-----------PAITAAAA
ORF5_nAD01|024A    GVLKAGGCYVPVSASLPRERAAFLLRGTAPVCLLTDPDAEAARHAAAGAQDPPGTARSGV
                    .. ::*  *:.:.     *   *         .   :

A3
ORF6_nAD02|024A    VDPAALASRGAHAPAG---DER-VRPAAPGGAAYAIYTSGSTGRPKGVVIDHSALGAYVG
ORF5_nAD02|024A    TEVLGLADPVFTAAGG---SALPAVQTHPRALAYVIYTSGSTGRPKGVGVERGALADYVD
ORF4_nAD03|024A    VDLPGPADELARAPEGPVTDRERPRPVGADTLAYVLYTSGSTGRPKGVAISRGSLAAHAV
ORF6_nAD04|024A    LDDPATEAALAGLDGADCTDADRRAPAGDRDPAYVVYTSGSTGTPKGVVVEQRSLAAFLV
ORF4_nAD02|024A    LGGEDAEAELAGRAPTPPDETDLARPVAGANAAYTIHTSGSTGRPKAVVVTRDALDAFVE
ORF7_nAD01|024A    LDAPRTVAALEELPGGPLGDGERPSPPDPGNAAYAIYTSGSTGRPKGVVATHRSLVGYLL
ORF4_nAD01|024A    LDAGVRCAEAEEPAPGDLP---------ADLPAYVVYTSGSTGRPKGVVVTHAGIAALAA
ORF7_nAD02|024A    PDDGPAGAEPDGPSAADLTDGDRNAPLTAGNAAYVVVTSGSTGRPKGVVTEHRGLLSLAV
ORF6_nAD01|024A    LDDPRTEAGIEAQDPAPVTDADRTAPLLPGHAAYVIHTSGSTGRPKGVVVDHRGLARLLQ
ORF4_nAD04|024A    LDSPRTRAAAAGLSAAPVTDADRRSPLLPDHPAYTIYTSGSTGRPKGVVVSHANVSRLLD
ORF6_nAD03|024A    LDDPATAERLAAAPGTAP-AGAAHAWGHPDDLAYTIYTSGSTGRPKGVMVTRAGVANFLA
ORF4_nAN05|024A    ACGAATLLAADAAQGAGP-LPEVPAP-LPDQAAYVLHTSGSTGRPKGVVVSRGNLANLLA
ORF5_nAD01|024A    ERIVLTEELLDRYDPSAPTDAERTAPLLPGHLAYLLITSGSSGRPKGVAVEHAQVAALLS
                                              **  ::****:*  **.*    :   :

A4
ORF6_nAD02|024A    GAR------GRYPDAA-GTSLAHTSLAFDLTVTTLLTPLAAGGTVRLGELDESAQT----
ORF5_nAD02|024A    GAV------RRYPDAA-GTALLHSPLTFDLSGTALFTPLAAGGCVVLGEVDREAEE----
ORF4_nAD03|024A    RSR------DRYPDAA-GVSLLHSPVAFDLTVTALFTTLVSGGTLLLAELDEHAQG----
ORF6_nAD04|024A    RSA------ARYRGAA-GTVLLHGSPAFDLTVTTLFTPLVAGGCIVVADLDAAEGDA---
ORF4_nAD02|024A    RTV------DTYGDALRGTSLLHSPVAFDLTVATLYGPPAAGGRIHVEDLDEAGIAR---
ORF7_nAD01|024A    RGS------QEY--PSDGRSLVHSPVSFDLTVGALYVPLVSGGTVRLASLDDEPVLR---
ORF4_nAD01|024A    EQI----DRYR-LGPG-SRVAQLAALGFDVAVAELAMALTSGSCLVLPPHG-LAGEE-LA
ORF7_nAD02|024A    AQR----ERYP-VRAG-SRVLQLASPSFDGAVLELLMAFATGGTLVLADRPLLAGEL-LG
ORF6_nAD01|024A    AHRRVTFSRIRPHGAGPARAAHVSSFSFDASWDPLLAMVAGHELHMIDEDLRLDPPG-VV
ORF4_nAD04|024A    VCR-----SAVDFGRD-DVWTLFHSSAFDFSVWEMWGALAHGGRLVVVPHDVARSPRDLL
ORF6_nAD03|024A    DLT-----ERLELGPDDRLLAVTTVSFDIAVLELFAPLLTGGAVVLADATAQRDPAAVR
ORF4_nAN05|024A    DMR-------ERLRLTAGDRLVAVTTVSFDIAALELFLPLVGGAELVLADRGTARDPEALA
ORF5_nAD01|024A    WAV------TGLGADRLRRTVAATSESFDVSVFDTLVPLLVGGRIEIVEN-----TLAVA
                             .  **  :               :
```

Figure 9b

```
ORF6_nAD02|024A    -----AGATLVKATPSHLPMLRE---LPGVLPDGG----TLILGGEALTGKQLRPWLELH
ORF5_nAD02|024A    -----SRATFVKATPSHLPLLER---HPGLLEEAG----TLVLGGEALDGRALRDWRAAH
ORF4_nAD03|024A    -----AGVTFVKGTPSHVALLDE---LPGVLDATGERPGTLVLGGEPLTGEMLERWRARH
ORF6_nAD04|024A    --PNR--PDLLKVTPSHLAFLDG---IASWAAPAA----DLVVGGEQLTGARLARLRAAH
ORF4_nAD02|024A    --WERECPAFLKATPSHLALLEE---FGGSAAPG-----TVVLAGEQLLGARLDWRARH
ORF7_nAD01|024A    --PGEAPPDFAKVTPSHLPVLEG---LPREVSPTA----AITFGGEQLTGRHLRRWRADH
ORF4_nAD01|024A    EFLRSRRITTALTTASVL---------ATVPPGDFPDLSDLATGGEQPPPPLIARW---A
ORF7_nAD02|024A    ETIAARRISHAFIPPAAL---------TGLTPEGLDCLRCLVVGGEAVTASVVDRW---A
ORF6_nAD01|024A    AYFRDRRIDYVDLTPTYFRSLL----DAGLLEETAPCPSLIALGGEAMDGELWERLRAAA
ORF4_nAD04|024A    ELLGRERVTVLSQTPSAFLQLLRAETERGVPAEATAALRYVVFGGEALDTAQLAPWR--G
ORF6_nAD03|024A    SLCAREGVTVVQATPGWWHAMA----VDGGLDLTG---LRVLVGGEALPATLARALLEPG
ORF4_nAN05|024A    ALLTGSGATILQATPTTWQLLA----ETAPDALRG---LRKLVGGEALPASLASRLHGLG
ORF5_nAD01|024A    DRAGGE-PSLLNAVPSALQALL----DRG-APLAV---DTFLCAGEPFPASLAAALRAAC
                                                                    .**

A5
ORF6_nAD02|024A    PA---AQVVNAYGPTELTVNCTEFRLPRGEP-VGDGPVPIGRPFPGVRAYVLGPGLRPVP
ORF5_nAD02|024A    PR---ATVVNAYGPTELTVNCAEHRIPPGGP-VPEGPVPIGRPFAGVRAMVLDAGLAPVP
ORF4_nAD03|024A    PQ---ARVFNDYGPSETSVNCSDLVFEPGDE-VPAGLLPIGRPLPGNHMFVLDHLLQPVP
ORF6_nAD04|024A    PG---MRVYNDYGPTEATVSCADFVLEPGDE-LPADAVPIGRPLAGHRLFVLDERLRPVP
ORF4_nAD02|024A    PG---TAVFNSYGPTETTVNCLEYRIAPGAE-TAPGPVPVGRPVAGVRVHLLDARLRPVA
ORF7_nAD01|024A    PD---VTVYNVYGPTETTVNCSEHRIAPRAP-VADGPVPIGRPLWNTRLFVLGPGLVPVP
ORF4_nAD01|024A    PG---RRMFNVYGPTEATVQATSGRCAAGGE-RMP----DIGNTEAGVDAYVLDGALRPVP
ORF7_nAD02|024A    PG---RRMLNVYGPTEATAVTLTSGALSPGG-PAP---AIGTPVPNTRAYVLDDRLRPVP
ORF6_nAD01|024A    PR---VTAMNTYGPTETAVDAVVT--ELGDL-PHG---TIGRPVPRWRAYVLDAGLQPVP
ORF4_nAD04|024A    RP---VRLVNMYGITETTVHVTHLELDDAAV-ERGG-SLIGSPLDDLRAHVLDERLRPVP
ORF6_nAD03|024A    RAPSGDRLLNLYGPTETTVWSTAAHITAGTPEARGGSVPTGTPIANTAAYVLDAALRPVP
ORF4_nAN05|024A    -----GELVNVYGPTETTIWSTAAHLDR----ATGSAPPIGRALRNTRAYVLDEWLDPVP
ORF5_nAD01|024A    PR---ARVGNLYGPTETTVFVTARFLDG----TEDGAPPIGRPLPGVRIHVLDPWLRPVP
                       * **:*  :          * .      :*.  * **.

A6                          A7
ORF6_nAD02|024A    TGTVGELYVSGTGVARGYLGRPGMTAERFVACPFGGPGERMYRTGDLAR-WRPDGN--LE
ORF5_nAD02|024A    PGVVGELYVAGPGVARGYLGRPGLTAERFLPCPFGEPGERMYRTGDLAR-RLPGGE--LE
ORF4_nAD03|024A    VGVVGEIYVSGVGVARGYHGRPGLTAERFLPCPFDAPGARMYRTGDLGR-WRPDGI--ME
ORF6_nAD04|024A    AGVPGELYIAGVGVARGYLGRPGMTAERFVGCPFGGPGERMYRTGDLAR-WRPDGN--LE
ORF4_nAD02|024A    PGVTGELYVCGPGVARGYRGRPAATAERFVACPFGEPGERMYRTGDLMR-WTPDGA--LL
ORF7_nAD01|024A    VGVPGELYVAGSGLARGYLRDPGRTAERFVACPY-AAGERMYRTGDLVR-WNEDGL--LE
ORF4_nAD01|024A    DGATGELYLRGRGLARGYLRRPGLTAARFVADPHTGTGERMYRTGDLVRRVPGEGRTVLE
ORF7_nAD02|024A    PGVTGELYLAGASLARGYGDRPGLTATRYVGCPFGEPGERMYRTGDLAR-WDREGR--VH
ORF6_nAD01|024A    PGVLGELYLAGPGVARGYLGQHGLTAERFVACPFGEPGERMYRTGDLAR-WLDDGN--LV
ORF4_nAD04|024A    SGVVGELYVAGPGLARGYRQRPGLTAARFVADPS-DAGGRMYRTGDLVR-RAPDGG--LH
ORF6_nAD03|024A    DGVPGELYLAGTGLARGYLGRPGMTAERFVACPFGGPGERMYRTGDLAR-WRPDGN--LE
ORF4_nAN05|024A    AGVPGELYLAGAGVARGYLGRGALTAERFTADPFGAPGSRMYRTGDLVR-RRADGE--LE
ORF5_nAD01|024A    EGVVGELYIAGDHVTRGYWRSPATTAERYVADPFGAPGERMYRSGDLGR-RLPGGE--ID
                    *. **:*:* *  ::***   .** *:   * .* ****:*** *     *     :

A8
ORF6_nAD02|024A    YAGRGDDQVKLRGFRIETAEVARALEGHPAVARAAVVLREDQPG-----------DQRL
ORF5_nAD02|024A    YAGRTDEQVKLRGFRIELAEVAQALAAAESVARAVAVIREDRPG-----------DRRL
ORF4_nAD03|024A    CLGRTDDQVKVRGFRVELGEVEAALAARPDVARATVVVREDEPG-----------DRRL
ORF6_nAD04|024A    YLGRDGGQLKVRGFRIEPGEIEAALLDRPEIGQAAVVLRG----------------ERL
ORF4_nAD02|024A    YEGRADAQLKVRGFRVEPGEVEAALLDLPGVREAAVTLVGGPGRG--SGQAGGSAAPARL
ORF7_nAD01|024A    YLGRADDQISLRGFRVEPGEVEAALAAHPAVRRAAVVMREDAAG-----------DARL
ORF4_nAD01|024A    FVGRADDQVKIRGFRVEPGEVEAALAELDGVAQALVTVREERPG-----------DRRL
ORF7_nAD02|024A    YVGRADEQIKLRGFRVEPGEVQARLTEHAAVREAAVVLREDEPG-----------ERRL
ORF6_nAD01|024A    CAGRGDEQVKIRGFRIEPGEVEAALRELEGVAQAAVAVREDTPG-----------TRRL
ORF4_nAD04|024A    YVGRSDAQVKLRGYRIEPGEVEAAARRHPDIGQAAVVHGDGPD-----------DRYL
ORF6_nAD03|024A    HLGRTDDQVKVRGFRIELGEVEKALAEAPGVGRAAAAVR--------PDPAGSAR----L
ORF4_nAN05|024A    FLGRTDHQVKVRGFRIELGEIETALGAHPDVSGAVVVARGASGPAPAPDDGGTAGPPRQL
ORF5_nAD01|024A    MVGRADGQVKVRGHRVELGEVESALVSHPDVRQAAATVH---------DGGPAGP--RL
                    ** * *:.:**.*:* .*:               : * ..                 *
```

Figure 9c

```
ORF6_nAD02|024A       VGYLVPVAG-----------------------------------------
ORF5_nAD02|024A       TGYVVPAAG-----------------------------------------
ORF4_nAD03|024A       TGYVVPEGGP----------------------------------------
ORF6_nAD04|024A       VAYVAAP-------------------------------------------
ORF4_nAD02|024A       VGYVVG--------------------------------------------
ORF7_nAD01|024A       VGYVVPAGEDAG--------------------------------------
ORF4_nAD01|024A       VGYLVPDPAG----------------------------------------
ORF7_nAD02|024A       VAYAVP--------------------------------------------
ORF6_nAD01|024A       VGYVVGADGA----------------------------------------
ORF4_nAD04|024A       VCYAVP--------------------------------------------
ORF6_nAD03|024A       VGYLVP--------------------------------------------
ORF4_nAN05|024A       VAYVVAEPDRAGHDGSRERARLDEWRETYDTLYDNSEPTPLGRDFGIWRSSYDGRPIPLE
ORF5_nAD01|024A       VGYVVP--------------------------------------------
                       . * .

ORF6_nAD02|024A       ----------------------------------------------------
ORF5_nAD02|024A       ----------------------------------------------------
ORF4_nAD03|024A       ----------------------------------------------------
ORF6_nAD04|024A       ----------------------------------------------------
ORF4_nAD02|024A       ----------------------------------------------------
ORF7_nAD01|024A       ----------------------------------------------------
ORF4_nAD01|024A       ----------------------------------------------------
ORF7_nAD02|024A       ----------------------------------------------------
ORF6_nAD01|024A       ----------------------------------------------------
ORF4_nAD04|024A       ----------------------------------------------------
ORF6_nAD03|024A       ----------------------------------------------------
ORF4_nAN05|024A       EMLQWRAATVDRIRALRPARLLEIGVGTGLLLSELAPDCTAYHGTDLSARVIETLHEQVA
ORF5_nAD01|024A       ----------------------------------------------------
                                         ^^^^^^^^^^
                                              M1

ORF6_nAD02|024A       ----------------------------------------------------
ORF5_nAD02|024A       ----------------------------------------------------
ORF4_nAD03|024A       ----------------------------------------------------
ORF6_nAD04|024A       ----------------------------------------------------
ORF4_nAD02|024A       ----------------------------------------------------
ORF7_nAD01|024A       ----------------------------------------------------
ORF4_nAD01|024A       ----------------------------------------------------
ORF7_nAD02|024A       ----------------------------------------------------
ORF6_nAD01|024A       ----------------------------------------------------
ORF4_nAD04|024A       ----------------------------------------------------
ORF6_nAD03|024A       ----------------------------------------------------
ORF4_nAN05|024A       AEPALKEKVELHVRPAHDFTGLRRGFYDTIVLNSVVQYFPGADYLSRVLRGALDLLEPGG
ORF5_nAD01|024A       ----------------------------------------------------

ORF6_nAD02|024A       ----------------------------------------------------
ORF5_nAD02|024A       ----------------------------------------------------
ORF4_nAD03|024A       ----------------------------------------------------
ORF6_nAD04|024A       ----------------------------------------------------
ORF4_nAD02|024A       ----------------------------------------------------
ORF7_nAD01|024A       ----------------------------------------------------
ORF4_nAD01|024A       ----------------------------------------------------
ORF7_nAD02|024A       ----------------------------------------------------
ORF6_nAD01|024A       ----------------------------------------------------
ORF4_nAD04|024A       ----------------------------------------------------
ORF6_nAD03|024A       ----------------------------------------------------
ORF4_nAN05|024A       RLFVGDVRSLALLRAFRASVEIGDAAAGDAPGPVLAAADRRTATEKELVVDPGYFARLRR
ORF5_nAD01|024A       ----------------------------------------------------
```

Figure 9d

```
ORF6_nAD02|024A      ----------------------------------------------------------
ORF5_nAD02|024A      ----------------------------------------------------------
ORF4_nAD03|024A      ----------------------------------------------------------
ORF6_nAD04|024A      ----------------------------------------------------------
ORF4_nAD02|024A      ----------------------------------------------------------
ORF7_nAD01|024A      ----------------------------------------------------------
ORF4_nAD01|024A      ----------------------------------------------------------
ORF7_nAD02|024A      ----------------------------------------------------------
ORF6_nAD01|024A      ----------------------------------------------------------
ORF4_nAD04|024A      ----------------------------------------------------------
ORF6_nAD03|024A      ----------------------------------------------------------
ORF4_nAN05|024A      ETGEPLVLDVRVRRGRPLNELTRYRYDVLLAKPEAGTAAPAPAAEMRWAEEVGDRARLAE
ORF5_nAD01|024A      ----------------------------------------------------------
                                      ^^^^^^^^^^
                                           M2

ORF6_nAD02|024A      ----------------------------------------------------------
ORF5_nAD02|024A      ----------------------------------------------------------
ORF4_nAD03|024A      ----------------------------------------------------------
ORF6_nAD04|024A      ----------------------------------------------------------
ORF4_nAD02|024A      ----------------------------------------------------------
ORF7_nAD01|024A      ----------------------------------------------------------
ORF4_nAD01|024A      ----------------------------------------------------------
ORF7_nAD02|024A      ----------------------------------------------------------
ORF6_nAD01|024A      ----------------------------------------------------------
ORF4_nAD04|024A      ----------------------------------------------------------
ORF6_nAD03|024A      ---------------------------------------------------------V
ORF4_nAN05|024A      VCAAHRGALRVTAIPNARVRRETAALAALEDGRPLAAARRLLDGPAGGVDPEDLYDVAAA
ORF5_nAD01|024A      ---------------------------------------------------------G--

ORF6_nAD02|024A      -----------EGVPD------------------------------------------
ORF5_nAD02|024A      -----------A-RPQ------------------------------------------
ORF4_nAD03|024A      -----------EAGLD------------------------------------------
ORF6_nAD04|024A      -----------EAEFD------------------------------------------
ORF4_nAD02|024A      ------------GAFD------------------------------------------
ORF7_nAD01|024A      DGAPPSAPAGSDTGLP------------------------------------------
ORF4_nAD01|024A      --------RDGSARGPD-----------------------------------------
ORF7_nAD02|024A      --------ADGLPR-PT-----------------------------------------
ORF6_nAD01|024A      --------DPGLLR--------------------------------------------
ORF4_nAD04|024A      --------DGDAD-PD------------------------------------------
ORF6_nAD03|024A      AG---------EGVPD------------------------------------------
ORF4_nAN05|024A      AGRTAWVCWSAEGPPDTVDLVLAPADGGGAAEVAPPAELWPYEPDADRPQTNDPSAALRN
ORF5_nAD01|024A      -----------DTVPD------------------------------------------

A9                    A10
ORF6_nAD02|024A      ---REAVSAAVAAVLPEYMVPSALVVLEDGLPLTANGKLDRAALPVPEFA--PVRGVGRA
ORF5_nAD02|024A      ---EDELRSTVARTLPEYMVPSSVVVLDE-LPTTPHGKLDRRALPAPAHR--SRG--GRP
ORF4_nAD03|024A      ---TAAVLRDLAAQLPEYMVPAAVVVLAE-LPRTENGKLDRRALPTPEYG--TRS-AGRA
ORF6_nAD04|024A      ---PAALREGLAARLPRYMVPAAIVRLDA-LPLAPGGKLDHRALPEPPAPADAPHDR-RP
ORF4_nAD02|024A      ---PAALLERLRVRLPDHMVPAALVELDA-LPLTPNGKLDRRALPAPDFGRHAGRRAPRG
ORF7_nAD01|024A      ---TAQITEHLRRMLPPYMVPSHLVELPA-LPVTPNGKIDRAALPEPPAAGDSAGGAPRS
ORF4_nAD01|024A      ---VERWRRLIAARLPAHLVPSALVELAE-IPRTANGKVDRSALPAPGGTPPPAGRAPR-
ORF7_nAD02|024A      ---AAELRAHLAALLPPYMVPSAYLVLDA-LPANANGKLDRDALPEPEPLAEEGGRPPS-
ORF6_nAD01|024A      ---PAEVLARLRDRLPDIILVPSALVRIGE-LPVNASGKLDRAALPAPDPAAFPAGRQPR-
ORF4_nAD04|024A      ---PHEVRAHLACALPGYMVPAAVVLLPA-LPLTPNGKLDRRALPAPDRAALATGGAPAG
ORF6_nAD03|024A      REAVS---AAVAAVLPEYMVPSALVVLEDGLPLTANGKLDRAALPVPEFA--PVRGAGRA
ORF4_nAN05|024A      RELAAGLRAYLAGRLPDYMVPSAVVVLG-ALPLTANGKVDRAALPDPDPA--GAAG-GRP
ORF5_nAD01|024A      ---TGAVLDHLRLRLPAYMVPSALVVLD-ELPLTGNGKRDRAALPPPPDR--SAATRARA
                       :  **  ::**:   :   :*      **  *:  ***  *
```

Figure 9e

| | |
|---|---|
| ORF6_nAD02|024A | PR |
| ORF5_nAD02|024A | PR |
| ORF4_nAD03|024A | PR |
| ORF6_nAD04|024A | PR |
| ORF4_nAD02|024A | PR |
| ORF7_nAD01|024A | PR |
| ORF4_nAD01|024A | -- |
| ORF7_nAD02|024A | -- |
| ORF6_nAD01|024A | -- |
| ORF4_nAD04|024A | PR |
| ORF6_nAD03|024A | PR |
| ORF4_nAN05|024A | P- |
| ORF5_nAD01|024A | PR |

Figure 10

```
ORF6_nTD02|024A    EEILCGLFAEVLGVPGVGVDDDFFALGGHSLLAIVVISRIRALLDVDLAIDALFEAPTVA
ORF7_nTD01|024A    EEILCGLFADVLRRPQVSIDDDFFALGGHSLLATRLASRVRAALDVELPVRRLFEHPTVR
ORF4_nTD04|024A    EEALCAAFADVLRVEEVSRDADFFALGGHSLSAVRLISRIRSALGVEIGIRTLFEAPTPA
ORF4_nTD03|024A    ETALCALFAEVLGVPGATVDDDFFALGGHSLLAVRLAGRIRAELGLRLDIRTIFDRRTVA
ORF6_nTD03|024A    EEILCGLFAEVLGVPGVGVDDDFFALGGHSLLATRLVARIRSTLGVELGVREVFETPTVA
ORF5_nTD01|024A    ETILLALFAEVLGVRPAGIDDDFFALGGHSLLATRLVSRVRTTLGAELGVRDLFEHPTVA
ORF5_nTD02|024A    ERALCRIYAEVLGVPEVGAEDDFFALGGHSLLATRLVNRIRSEFADELDVRAVFEARTVA
ORF4_nTD01|024A    EEALCALFAEVLGVEEVGADHDFFALGGDSLLAARLASRTRNRIGKAVTVREVFRAPTAA
ORF7_nTD02|024A    EAALCEVFAEVLGREWIGADDGFFENGGHSLLATRLVTRVRERLGVPVAARDLFEAPTAA
ORF6_nTD01|024A    ERDLCALFADVLGTGSVGIDDDFFVRGGDSTLSIQLVGSAR-RAGLEFKVRQVFELRTPA
ORF4_nTD02|024A    EELLCTLFAEVLGLPEAGAEDSFFALGGDSIVSIQLVGRAR-RAGLHFTVRDVFEHPTAA
ORF6_nTD04|024A    ERVLCEAFREVLGVAEVGADDDFFALGGDSIGSIQLVGRVR-RAGGRMTVRDVFERRTPA
ORF4_nTD05|024A    EELLCRLFADLLGLSRVGTEDSFFSLGGDSTLSVRLVSRAR-EQGLPLTTRDVFEHHTVA
                    *  *    : ::*        : .**  **.*:  :    *       .   :*    *

ORF6_nTD02|024A    GLAAHLDG
ORF7_nTD01|024A    SLSALLDS
ORF4_nTD04|024A    ALARRLDT
ORF4_nTD03|024A    DLLADP--
ORF6_nTD03|024A    GLAAALSR
ORF5_nTD01|024A    ALGARIAR
ORF5_nTD02|024A    ALAARLRT
ORF4_nTD01|024A    GLAEALGG
ORF7_nTD02|024A    GLAERIGR
ORF6_nTD01|024A    GLATVARR
ORF4_nTD02|024A    GLAAVARA
ORF6_nTD04|024A    ALAARSRQ
ORF4_nTD05|024A    ALAAALDG
                    *
```

Figure 11

```
                                    E1
ORF6_nED01|024A    DPGAAVGPLPPLPVVAETLAAGG-----PVGEYNQSVVLASPPGAGPDDVRDALQALLDR
ORF6_nED04|024A    LGGRATGPVPPTPISSWLAELGG-----AAEGYNQSVLLRVPAQADEAVLVGALQALLDH
ORF4_nED02|024A    PGLPPSGPLPYVPAAARLVARTGSIRARGADRFHQSVVLTAPADAGPDDVRRVLQTVIDH
                     .**:*  *   :           *    .  ::***:*  *. *.   :   .**:::*:

ORF6_nED01|024A    HDALRIHAAPAAEPGRLWDLRVERAGTVTAERCLRKIDAAGMSEEELAEAVAAEAVAARE
ORF6_nED04|024A    HDALRMRAEPAAG---HWRMEIGEAGGVDAAAVLERVPAADVPQAELDRLVRAHCAAARE
ORF4_nED02|024A    HGALRLRAAADRD-GAPDGLVIGEPGSVAAADLLRCRDAAGLPEAALREAVEQEARQARD
                   *.***::*  .       : :  .** **  *.  **.:.:  * . *  ..   **:

E2
ORF6_nED01|024A    ALDPVACALVGAIWFDRG-GEPGRLVLVIHHLAVDGVSWRILLGDLREAWRALR-DGRRP
ORF6_nED04|024A    RLAPQEGAMLRAVWFDRGPREPGHLALVAHHLVVDGVSWRILTADLGRAWQAVA-DGREV
ORF4_nED02|024A    GLDPSTGSVLRAAWLDRGPDRGGLLVLVAHHLSVDGVSWRILLDDIRHAWSTPAGPAGGT
                    * *   *.::: * *:***  . * *.** *** ********* *: .**  :    .

ORF6_nED01|024A    ELPRTGTSLRTWATRLADRAADPAVTAQLDHWTATLADAGPEVGSR-----PLDRTRDTA
ORF6_nED04|024A    RLDPVGTPLRVWAQRLAELAADPRRADRCAYWEEQAARP-WEAG-------RLDPAADDR
ORF4_nED02|024A    PLPPEGTSLREWATRTAGAAAGAAVTGRLPHWRQTLAGLEDPDGEVVALEVRLDPAADTH
                    *   **.** ** *  *  **..  :  : :*   *   *      **   :  *

E3
ORF6_nED01|024A    ATSAVLSGELPEPVTAALLGPAPAAFRAGVNDLLLTAFALAVNHWR-GEEGEPVLVDLEG
ORF6_nED04|024A    STEEALSLTLPAGTTRAVLGSVPAALGVGVTEVLLGTFAAAVRRWRPAEAADGVTVDLEG
ORF4_nED02|024A    GSARETAHRLPPDLTDALVRTAPAALRAEPGELLLAGYALAASRALGGRPV--FVVETEG
                    .:       :   *  * *::  ..***:      ::**  :* *.  :  ..   . *: **

E4                 E5
ORF6_nED01|024A    HGRAEDLVPGADLSRTVGWFTSVYPVRLAAGAVTAADLAGRAPAVGDAIKRVKEQLRAVP
ORF6_nED04|024A    HGREEEVVPGADLSRTVGWFTAAHPVRIPA-AGPDDDRAG-------ALRALAGTLDRVP
ORF4_nED02|024A    HGRQDALLPGIDLSRTVGWFTSVHPVRLRPGAGAAR----------LLKETRERLRTVP
                   ***  : ::** ********** :.***:  . * .                ::   *  **

E6                        E7
ORF6_nED01|024A    DEGLGYGLLRH--LNPETSRRLAHGARARFGFNYLGRFA---AEQGGGEDG--WQLLGSG
ORF6_nED04|024A    DAGLGYGMLRY--LNPRTRERLASLPAPRFGFNYLGRFGDPGADRDGAAEAPAWSPVGSG
ORF4_nED02|024A    DAGLGHDLLRHGGAAPSSGEGGRGLPRPQFGFNYLGRVAVAEAPAGTDPGG-TWAFAGHS
                   * ***:..:**:      *  :  .    .:********..    *      .   *   *  .

ORF6_nED01|024A    PAGRHPDTPLDHEIEVNAVTAEGPDGPRLITRWTYATGLLTEEEVRRLARSWSLALHAVV
ORF6_nED04|024A    VAGQPAGLPLAHEIEVNAVAADGPDGPRLIATWSWAGRLHREQDVRELAGLWFRELDELA
ORF4_nED02|024A    VAPQPPELPLAHEVELTVVLEDGPGGPVLAARWNASARCLSRARQDALAREWEKALRELV
                    *  :   **  **:*:.  .*  :**.**  *  :*  .    ** *   *  :.

ORF6_nED01|024A    GHATGAGAGGLTPSDVA-VPDLGQAEIEELERRCGTA
ORF6_nED04|024A    SAERSPAAGPPPPADPAPLVELSDAELDQLEAEWKAD
ORF4_nED02|024A    ALAGTAGGGGLIPSETG-AGGLDQDEIEECEAAADFE
                    .    ...*   *::  .     *.:  *:::  *
```

Figure 12

```
ORF7_nTE02      |024A       GLGWAYAGLLQRLPADVPLYALQARTPAAGGGLPRSIEEMAGDYVRLVRAVRPHGPYRLL
CAD55498_nTE02|CADA         GMSWCYSGLVRHLPPGIPVYGLQAAGLDGDGPLPATLQEMAAEYADLVRQTQPEGPYRLL
                            *:.*.*:**::.**..:*:.***    ..* ** :::***.:*. ***  .:*.******

Te
ORF7_nTE02      |024A       GWSLGAHVAHTMAGLLERDGERVDLLAVLDAYPPHRTGTTGREGTEAEIVAANLRESGFA
CAD55498_nTE02|CADA         GWSLGGNVAFAMARELRARGQEVELLAFLDAYP-RRAG-AGPEAPLAEVFAHNLRDAGFD
                            *****.:**.:**  *.  *:.*:***.***** :*:* :* *.. **:.* ***::**

ORF7_nTE02      |024A       WEEAELRDGRFPLERFRAHLRRMDSSLGHLDDGELTAAKDVYVNNVRLMRSHTPGRVRCG
CAD55498_nTE02|CADA         VAEEELTGGRFPTARYRAFLNAAGDPMGRLDEAELAAVLEVFMNNAALMRGHTPGTYDGD
                            * ** .****  *:**.*.   ...:*:**:.**:*.  :*::**. ***.****   .

ORF7_nTE02      |024A       IVLMTAERSRS-----LDPGAWDAHTEEGVEVHRVDAAHMSMLTEPTSVAEVGRVLTRRL
CAD55498_nTE02|CADA         VLVLAAERADGDKLARRGAESWRPHVRGRIERVGVDADHLGLVQSDAALAVIGRALAGRL
                            ::::***: .     ..  :* .*..  :*   *** *:.:: .  :::* :**.*: **

ORF7_nTE02      |024A       DSLRGADTKKR--------
CAD55498_nTE02|CADA         DPATGHAASAAVPETEGVTA
                            *. *  :.
```

Figure 14a

```
ORF2_ADLE|024A    ------------------------------VAHVSGPPADPPAGSHLVAAIRATAEAD
ORF1_ADLE|A541    LTVRAEHRKASTLPPGNPAVSSGDSASRREKRAAAGSSSSADPLAGPHLVAAISATAEAD
ADLE|RAMO         ---------------------------------------MVIDAATQPTVPDAFRAQAIAR
ADLE|DAPT         ---------------------------------------VPAVSESRCAGQGLVGALRTWARTR
ADLE|A410         ---------------------------------------MVELGSAESIPAVLRRHAENT
                                                         .  :   :  .:   *

ORF2_ADLE|024A    PERKAVGFVRDPEREGEEALRSYSWLDDRARRIAVLLRGARLGAGSRVLLLFPQSAEFAA
ORF1_ADLE|A541    PGRKAVGLVRDPEREGEEALRSYAWLDDTARRIAVLLRAAGLETGARVLLLFPQSAEFAA
ADLE|RAMO         PGEPALVVLPG-DPDAEPVTLTYAELDRRAAARAAWLA-ARFPAGERILIALPTGAEFVE
ADLE|DAPT         ARETAVVLVRDTGTTDDTASVDYGQLDEWARSIAVTLR-QQLAPGGRALLLLPSGPEFTA
ADLE|A410         PDRAAHAFVTDLDEAGGVAWLSHAELDRRARAVAAQLS-AHAAPGDRMLLLHPAGPDFLI
                   . . *   .: .     .  :. **   *  *. *   .* * *:  *  ...:*

ORF2_ADLE|024A    AYAGCLYGGMVAVPAPLPTGTSLETARVAGIARDAGAGAVLTVSDTEAEVRRWAAETGLG
ORF1_ADLE|A541    AYAGCLYAGMVAVPAPLPTGTSHEAARVVGIAKDSEAGAVLTVSETEADVRQWAARTGLG
ADLE|RAMO         LYLACLYAGLVAVPAPPPGGSSGASERTVGIAADCSPALAVVNADDAAPLTAVLRERGLS
ADLE|DAPT         AYLGCLYAGLAAVPAPLPGGRHFERRRVAAIAADSGAGVVLTVAGETASVHDWLTETTAP
ADLE|A410         ALLGCLHAGLIAVPSPLPGRYAHQRRRVRLIAADADVTAVLTDRATRAEVVEWAAEQGLP
                   .**:.*: ***:*  *         *    **  *        *  .

Domain I
ORF2_ADLE|024A    DLPLFSVDELPDDTDPGEWREPEIRAGTVAVLQYTSGSTGSPKGVVVTHGALADNVRSLL
ORF1_ADLE|A541    ALPLHCVDELPGDADPDTWREPEIRADTVAVLQYTSGSTGSPKGVVVTHGALADNVRSLL
ADLE|RAMO         GLPVGALPP---LAAEAIRPPRGPRPDSLAVLQYSSGSTGSPKGVMLSHRAVLANLRAFD
ADLE|DAPT         ATRVVAVDDRAALGDPAQWDDPGVAPDDVALIQYTSGSTGNPKGVVVTHANLLANARNLA
ADLE|A410         DIAVLTPDP---EADPGDWQPPPLSRDTVAVLQYTSGSTGNPKGVVIDHGNILSNAATII
                    :         .  :.**:*****.****::  *    :  *    :

ORF2_ADLE|024A    SGFDLGTGARLGGWLPMYHDMGLFGLLSPALFSGGAAVLMSGSAFLRRPHLWPTLIDRFG
ORF1_ADLE|A541    TGFDLGSGARLGGWLPMYHDMGLFGLLSPALFSGGAAVLMSGSAFLRRPSQWLRLIDRFG
ADLE|RAMO         RSSGHNSDDVFGSWLPLHHDMGLFAMLTAGLLNGAGVVLMSPTAFVRRPADWLRMMDRYR
ADLE|DAPT         EACELTAATPMGGWLPMYHDMGLLGTLTPALYLGTTCVLMSSTAFIKRPHLWLRTIDRFG
ADLE|A410         AVTGIRPGTVIGGWLPHFHDMGLMGLLLPPLLAGATTVLSSPVSFLKRPLSWLRMIDRYG
                    :*.*** .*****:. *   * *   **  *  :*::**  *    :**:

ORF2_ADLE|024A    VVFSAAPDFAYDYCVRRVEPEQVDRLDLSRWRWAANGSEPIRAETLRAFTKEFAPAGLPH
ORF1_ADLE|A541    LVFSAAPDFAYDYCVRRVRPEETDGLDLSRWRWAANGSEPIRAETLRAFAKEFAPAGLHP
ADLE|RAMO         VTISAAPNFAYDLCVRAVRDEQIAGLDLSRIRTLYNGSEPVNPATVRAFTERFAPFGLHT
ADLE|DAPT         LVWSSAPDFAYDMCLKRVTDEQIAGLDLSRWRWAGNGAEPIRAATVRAFGERFARYGLRP
ADLE|A410         VEITAAPDFAYDLCVAKVTDAELATLDLSRWRVAINGSEPVRAAVLTRFRQRFAAAGLRP
                   :  ::**:**** *:  *    :    ***** *   **:**:.. .:  * :.** **

Domain II
ORF2_ADLE|024A    DAMTPCYGLAEATLLVSL-----SAGELRTRRVDAAALENHRFVEAAAGRPSREVVSCGR
ORF1_ADLE|A541    NATTPCYGLAEATLLVSL-----PTGELRTRRVDVAELENHRFVEAAVGRPSREIVSCGR
ADLE|RAMO         HAVNPCYGMAEFTAYVSTKVFEAPAVFLPADPRALEDAASPALRPADP-AAAREIPGVGR
ADLE|DAPT         EALTAGYGLAEATLFVSR-----SQG-LHTARVATAALERHEFRLAVPGEAAAREIVSCGP
ADLE|A410         EVLTPSFGMAEATLFVSGD----PATPFVVRRVDTDRLARHRFEPAPDGGPGRDVVACGA
                    .. .. :*:** *  **            . :.         : *  ...*::. *

ORF2_ADLE|024A    PPALEVRVADPATGEPVTG------DAVGEIQVRGASVAGGYWRKPEATAETFVTAADG-
ORF1_ADLE|A541    PPSLEIRVVDPATGKSVTGGDGAGETRVGEIRVRGASVARGYWQKPEATAETFVMDADG-
ADLE|RAMO         VPDFEVLIVDPDGLRPLPE------GRVGEIWLRGPGAGAGYWGRTELNPGIFDARPAGD
ADLE|DAPT         VGHFRARIVEPGGHRVLPP------GQVGELVLQGAAVCAGYWQAKEETEQTFGLTLDGE
ADLE|A410         PAGVEVRIVDPGSGDPLPD------GAVGEIWLRGPSIGRGYWGRAANTAGFGAVTSIG-
                    .. :.:*   :.       ***: ::**   *       .       *
```

Figure 14b

```
                        Domain III
ORF2_ADLE|024A     --SGPWLRTGDLGALYEGELYVTGRIKELLIVHGRNIYPHDVERELRAHHDELG-AIGAV
ORF1_ADLE|A541     --SGPWLRTGDLGALYEGELYVTGRIKELLIVHGRNIYPHDIEHELRARHAELG-AVGAA
ADLE|RAMO          GQDGGWVRTGDLGALTGGELFLTGRLKELLIVHGRNLAPHDLEREARAAHDAVDHQIGAA
ADLE|DAPT          --DGHWLRTGDLAALHEGNLHITGRCKEALVIRGRNLYPQDIEHELRLQHPELE-SVGAA
ADLE|A410          --DAGYLRTGDLGTLYEGQLYVTGRRKDMLVLRGRNYYPQDIEHELRAHHPELAGRVGAC
                     ::*****.:*  *:*.:*** *: *:::***  *:*:*:* *   *   :  :**

ORF2_ADLE|024A     FSVPTEEGE-----AVVVTHEVVPSVRDDRGPALVTAVRATLAREFGLAPAGVVLVRRGR
ORF1_ADLE|A541     FSLSTESGE-----VVVVTHEVNPTVRPEQGPELVTALRATLAREFGLAPAGVVLVRRGR
ADLE|RAMO          FGVPAPDER------IVLVQEVHPRTPLDELPRVASAVSRRLTVSFGVPVRNVLLVRRGT
ADLE|DAPT          FTVPAAPGTP----GLMVVHEVRTPVPADDHPALVSALRGTINREFGLDAQGIALVSRGT
ADLE|A410          FAVRSRDGAGGGEEVLVVTHEVRGISDPDRLRTLAGAMRLTVAREFGVPSAAVLLLRPGA
                   *  :  :        :::.:**         :   :. *:   :   .**:    : *: *

ORF2_ADLE|024A     TPRTSSGKVQRRLAARLFRTGELAQVHADPGAHRLVAALREADG------LRDAPASTT-
ORF1_ADLE|A541     IPRTSSGKVQRRLTARLFSTGELAQVHADPGAHRLLAELREAHDRGGAFPPPSPPASQDP
ADLE|RAMO          VRRTTSGKIRRTAVRERFLAGGITALHAELEPALRPVQAGAGR-----------------
ADLE|DAPT          VLRTTSGKVRRGAMRDLCLRGELNIVHADKGWHAIAGTAGEDIAP-----TDHAPHPHPA
ADLE|A410          VARTTSGKIQRSAMRELFETGALEPVGGEVDDRLVATAALGAAR----------------
                   **:***::*     *  :   .:

ORF2_ADLE|024A     --
ORF1_ADLE|A541     EA
ADLE|RAMO          --
ADLE|DAPT          --
ADLE|A410          --
```

Figure 15

```
ORF3_ACPH|024A    MSLSPPSSSPPSSPPPSPPHDPDALRQWLREQCADCLGVPPASLATDVPLTDYGMTSVTG
ORF1_ACPH|A541    ----------------------LRQRLRELCADCLGVPVDSLATDAPLTDYGMTSVTG
ACPH|RAMO         ---------MSETDLSAARHTPEQIRSWLIDRIAYYVMLPTQEIEPDVSLAEYGLDSVYA
ACPH|DAPT         ------------MNPPEAVSTPSEVTAWITGQIAEFVNETPDRIAGDAPLTDHGLDSVSG
ACPH|A410         ---------MS--DLTAVP-TPESLRAWLVDCVADHLGRAPAGIATDVPLTTYGLDSVYA
                                    :   :    .   :   *..*: :*: ** .

ORF3_ACPH|024A    TALCGMVEDHLDVECDLSLLWQFQTTDGITSRLASRTAR--
ORF1_ACPH|A541    TALCGMVEEYLDVECDLELLWQEPTIDGLASRLASRTVR--
ACPH|RAMO         FALCGEIEDTLGIPIEPTLLWDVDTVATLTAHLADRVNR--
ACPH|DAPT         VALCAQVEDRYGIEVDPELLWSVPTLNEFVQALMPQLADRT
ACPH|A410         LSIAAELEDHLDVSLDPTLEWDHPTIDALSAALVAELRSA-
                  ::..  :*:  .:  :   *:*.  *:  :   *    .
```

Figure 17a

```
                              C1                                                    C2
ORF4_nCD01|024A      ADRVAATSAQSGIWTAQRLRSDDRLYTCGLYLELDHVVE-EVLGEAIGRAVADTEALRTA
ORF7_nCD01|A541      AHRVAATSAQTGIWTAQRLRGDDRLYACGLFLELDHVVE-EVLSEAIRRAVADTEALRTA
acyl-Cdomain|RAMO    PDLRPLTPAQLAVWHAQQLAPHSPVYQVGEFVEIDGECDPDLLVAALRQVMGEAESARLR
acyl-Cdomain|DAPT    SQRLGVTAAQQSVWLAGQLADDHRLYHCAAYLSLTGSIDPRTLGTAVRRTLDETEALRTR
acyl-Cdomain|A410    VDRRPVSAAQLGIWVAQQVLPDSPLYNCGCYYEIG-AADPGLLDRAVRHTLAETEALRSR
CAB38518_nCD01|CADA  SVRHGLTSAQHEVWLAQQLDPRGAHYRTGSCLEIDGPLDHAVLSRALRLTVAGTETLCSR
                      :.**   :* * ::            *    . :    :   * *:  .:  :*:

ORF4_nCD01|024A      FGEDGDGALEQRVLARPPD-------------TQTRLFRLDLGGDDRPRAEALDWMDRQQ
ORF7_nCD01|A541      FREDADGALEQHVLARPPS-------------TQTRLFHADPSGGTPSRSASLDWMDRQR
acyl-Cdomain|RAMO    FRVI-DGTPWQYVAEDGDD----------------PIQVVDLGAAADPRAAALGRMAADL
acyl-Cdomain|DAPT    FVPQ-DGELLQ---ILEPG-------------AGQLLLEADFSGDPDPERAAHDWMHAAL
acyl-Cdomain|A410    FETI-DDQLWQLVGPADPE---------------PLEVVDLRAEPDPEAAARRWMGAAM
CAB38518_nCD01|CADA  FLTDEEGRPYRAYCPPAPEGSAAVEDPDGVPYTPVLLRHIDLSGHEDPEGEAQRWMDRDR
                     *       :.   :                        :      *   . ..   :    *

C3
ORF4_nCD01|024A      AEPWDLAAGDTCRHTLIRLGGHRTVLHLRYHHLALDGFGAALYLDRIAAVYRALRTGRET
ORF7_nCD01|A541      AQPWDLASGDTCRHTLIPLGGDRSLLHLRYHHLALDGYGAALYLDRLAAVYRALRTGHQP
acyl-Cdomain|RAMO    DRPGDLRDGPLVEHHVYLLGEGRVIWYHRAHHIVCDGGSLGIVASRVAGVYSALAAGGDV
acyl-Cdomain|DAPT    AAPVRLDRAGTATHALLTLGPSRHLLYFGYHHIALDGYGALLHLRRLAHVYTALSNGDDP
acyl-Cdomain|A410    AEVRPLGRAPLSRQAVLLLGADRRLWFHGYHHAVLDGFGQSVYAARVAQVYAALAAGRTP
CAB38518_nCD01|CADA  ATPLPLDRPGLSSHALFTLGGGRHLYYLGVHHIVIDGTSMALFYERLAEVYRALRDGRAV
                       :   :    :   ** *:.   ** .**. :    *;* ** ** *

C4
ORF4_nCD01|024A      PPCTFAPLARLVEEDRAYRRSARHRRDADHWRTRFADLPRPTSLAGA-----------A
ORF7_nCD01|A541      PPCAFAPLARLVEEDHAYRNSARHRADANHWRDRFADLPRPTSLADATTPAAPTTPATPA
acyl-Cdomain|RAMO    RPGALPPLSVLLSAADAYERSGDRDRDREHWRSALAGLPAELLAGAGR-----------P
acyl-Cdomain|DAPT    GPCPFGPLAGVLTEEAAYRDSDNHRRDGEFWTRSLAGADEAPGLSER-----------E
acyl-Cdomain|A410    PERVFATLDEAHADAAVDPASRRFAADRDYWLGAFADRPEPVGLAGR-----------A
CAB38518_nCD01|CADA  PAAAFGDTDRMVAGEEAYRASARYERDRAYWTGLFTDRPEPVSLTGR-----------G
                       :             .    *     *  .*    ::.

ORF4_nCD01|024A      APAAPAALRHTVRVSAADTAALGLRADRSGSTWPVFATAAVAAFLSRLAPGEEVVVGFPV
ORF7_nCD01|A541      APAAPDELRRTVRLSAARSAALRRASDRSGRPWPVYATAAVAAFLSRLAPGEEVVVGLPV
acyl-Cdomain|RAMO    RPLPGPPVRHEHDLSAAEAGRLRAGARRLRTSVAQAGIAAAALYQHRLTGARDVLVAVPV
acyl-Cdomain|DAPT    AGALAVPLRRTVELSGERTEKLAASAAATGARWSSLLVAATAAFVRRHAAADDTVIGLPV
acyl-Cdomain|A410    GAAGPTQLRRIRPLPPGCAARFAAAAEAVGSTWPAAVIAAVAAYYHRMTGREEIVFALPL
CAB38518_nCD01|CADA  GGRALAPTVRSLGLPPERTEVLGRAAEATGAHWARVVIAGVAAFLHRTTGARDVVVSVPV
                      :   :. :     .         .     *..*  * :   :...*:

C5                    C6           C7'
ORF4_nCD01|024A      TARVTPAAVRTPGMLANVVPLRIRVRQGMSFAALLDRTAAEIGATLRHQRHRTEDIGRAL
ORF7_nCD01|A541      TARVTPAAVRTPGMLANVVPLRLPVRQGMSTAELLELTAAEISTTLRHQRHRTEDIGRAL
acyl-Cdomain|RAMO    AGRTTRPEFDVPGMTSNVVPVRLAVTPATTVGELLRDVARGVRDGLRHQRYPYPNIVDDL
acyl-Cdomain|DAPT    TARLTGPALRTPCMLANDVPLRLDARLDAPFAALLADTTRAVGTLARHQRFRGEELHRNL
acyl-Cdomain|A410    AGRRGRASLSTPGALVNVLPIRLSVSSRATFAELARQAGRRLADVLRHQRFRGEQLFQEL
CAB38518_nCD01|CADA  TGRYGANARITPGMVSNRLPLRLAVRPGESFARVVETVSEAMSGLLAHSRFRGEDLDREL
                     :.*       .*     * :*:*:.       . . .:        *.*.  ::     *

ORF4_nCD01|024A      GLPPHGAQPAPTLVNVMAFAPVLDFGDCLSPVHQLSAGPVEDLAVNLLGTPGDG-----R
ORF7_nCD01|A541      GL--HGAPPATTLVNVMAFAPVLDFGDCRAPVHQLSAGPVEDLVVNLLGTPGDGGESDGT
acyl-Cdomain|RAMO    GLADR-AALRPVTVNALALGRPLRFGSAVGVRSGLSAGPVDDVTIGLYEKVSGG------
acyl-Cdomain|DAPT    GGVGRTAGLARVTVNVLAYVDNIRFGDCRAVVHELSSGPVRDFHINSYGTPGTP-----D
acyl-Cdomain|A410    GLSGERAFWG-PTVNVMGFGGDLALGPVTAVPHPLATGPVQDLKINFYGTPATG------
CAB38518_nCD01|CADA  GG----AGVSGPTVNVMPYIRPVDFGGPVGLMRSISSGPTTDLNIVLTGTPESG------
                         *          **.:   :  :*   .   :::**. *. :       .
```

Figure 17b

```
ORF4_nCD01|024A        ELEITVAANPLLHSEDAVASLAARLAEFLARAGE-HADAPIGRTRLLGAA
ORF7_nCD01|A541        ELEITVAANPRLHSADAVASLAARLAEFLTHMGQ-DAEAPLGRTRLLDAE
acyl-Cdomain|RAMO      GMQTIAELNPGRTDRPDAAEVSRWFRTLLRGLAESDAGDPVARIDIVDEP
acyl-Cdomain|DAPT      GVQLVFSGNPALYTATDLADHQERFLRFLDAVTA-DPDLPTGRHRLLSPG
acyl-Cdomain|A410      -VRLELDADPARYDAVAVAEHQDRLIRLLTALGH-DPATRIGAVDLLDPA
CAB38518_nCD01|CADA    -LRVDFEGNPQVYGGQDLTVLQERFVRFLAELAA-DPAATVDEVALLTPD
                        :.      :*       :    :    :*      ..         ::
```

Figure 19

```
ORF16|024A      MGLRVVCEQRRISAPHAVRVVDDETHRMTGLVEMQADALAETDFYLPSMTLEDYLRDAVP
ORF15|A541      ------------------------------MQ--ADAPAGTKTGTETYLPSLSLEDYLRDTVP
MTFZ|DAPT       ----------------------------------VTGETRTTTYLPGMTVHDYHVTVKE
MTFZ|CADA       -----------------------------------------MTGDDVQGQLAELRR
                                                           :..   :..

ORF16|024A      AHPVLKAAVDFGRPGADKALRALAAT-TTEFDSDDTG-RGDSYRRAQRN-SSVRWRGIRQ
ORF15|A541      AHPVLKSSVDFGRPGSDEALRALAAT-TTEFDSDETG-RGDTYRRAQQD-PSVRWRGMRQ
MTFZ|DAPT       QHPALFELLDPAR-LVAVTDEPWVTE-GNEFDDDHTG-RGVSYRCAQQH-GEARRTGIET
MTFZ|CADA       SHPELHALADPRRIAAWEAARGSAPGRHDDFGADGEGSRGVEYVQAQALNRRARETGIRK
                 **  *    *    *              :*. *  ** * **     .*  *:.

motif I
ORF16|024A      LLELAAPS----DAAAPHIVLDVLGGDGTIARAVHEHA-PDLRDRVSILTGDLSGDMVER
ORF15|A541      LLELAAPSRAPSDTAAPRTVLDVLGGDGTIARAVHDHA-RELWDRPHILTGDLSGDMVER
MTFZ|DAPT       ILGMFAGPGGLRDMGR---VLDVLGGEGLLSRVWRQLAGAGDGDSVPLVTGDLSGHMVAA
MTFZ|CADA       LLGFAETARRTAAGDRP-VLVDLLGGDGLVRKVCEELG----IGDFNILTCDASPHMVTT
                :*  :   .         ::*:***:*' :  :.. .: .        ::*   *  .**

motif II                motif III
ORF16|024A      ALAQGLPAVRQAADHLFLGDRTVDAALLAYGTHHIAPQDRLNAVTEALRVVRDGGRVVLH
ORF15|A541      ALAQGLAAIRQAADHLFLADGTMDAALLAYGTHHIAPQERLAAVTEALRVVKDGGHVVLH
MTFZ|DAPT       ALRSGLPAVRQPADRMLQRDHCLDGVLFAYGTHHVDRSVRPRMLTEASRVLAPGGRVVLH
MTFZ|CADA       AWAAGVPALLQRAEQPLLRDHSVDAVLLAYGSHHVPSSDRQTVATEARRMLRPGGTFVLH
                *   *:.*:  * *::  :   * :*...*:***:**:   . *    *** *::   ** .***

ORF16|024A      DFDDASPMARFFTDVVHPHTTAGHDYRHFSRGSLVELFEEAG-TPARVVDLYDPLVVRGD
ORF15|A541      DFDDASPMARFFTDIVHPHTTAGHDYRHFSRDLLAELFAEAG-TPARVVDLYDPLVVRGT
MTFZ|DAPT       DFAEGSPEERWFREVVHPRSLAGHAYDHFTAHEMTGYLADAGFTDITVGPVYDPMTLTGE
MTFZ|CADA       DFLVGSPVDVWFEEVTDVYSATGHKFLHFTRDEIEGYLEKAGYDHREVVEIDDPYTAVAA
                **  .**   :* ::..   : :**  **:   :     :  .**     *  :**  .  .

ORF16|024A      TEEDARRRMCEYVADMYGVG-EYFAAQGGTDARWRILERYFGHEGYLAGLPAEV--DFTP
ORF15|A541      TEEEARRRMCAYVADMYGVG-AFFATLGGTDACWRLLEEYFQHDTYLSTLPEQT--DFTT
MTFZ|DAPT       TEESALARLVSYMTSMYGILPDGDRSNERTEAALRDIFRFSAGD-----LPEDVPRDEAV
MTFZ|CADA       TPEEAELEIGRYLLNMYGLVKVFEGRTEQEAYRWVAETAKAVFR-----YPDAEG-GLAS
                * *.*  .:  *: .***:                                 *     . :

ORF16|024A      RPVVYRSRG-AYVAEVPRAAMVAVARKTA------
ORF15|A541      APIVYRSEG-AFIAEIPRAAIVAVSHKPPT-----
MTFZ|DAPT       LELTVRPHGNAFRAELPRIALVAHGRKP-------
MTFZ|CADA       SELRQEGTG-GWRVTIPRRAVVGVGRVSATAGKAA
                 :   . *  .:   :**  *:*  .:  .
```

Figure 20
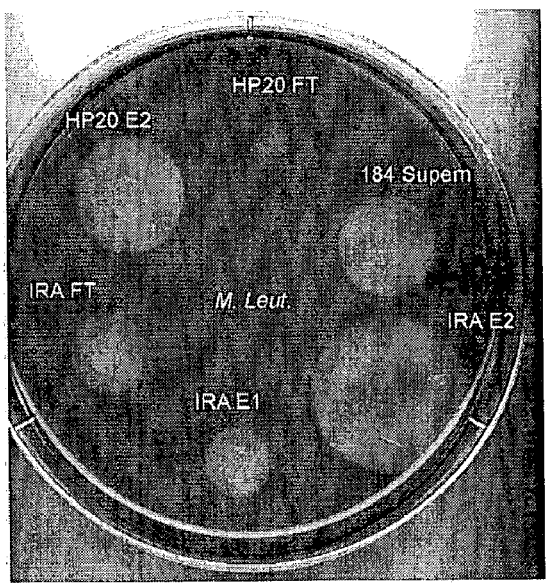
a
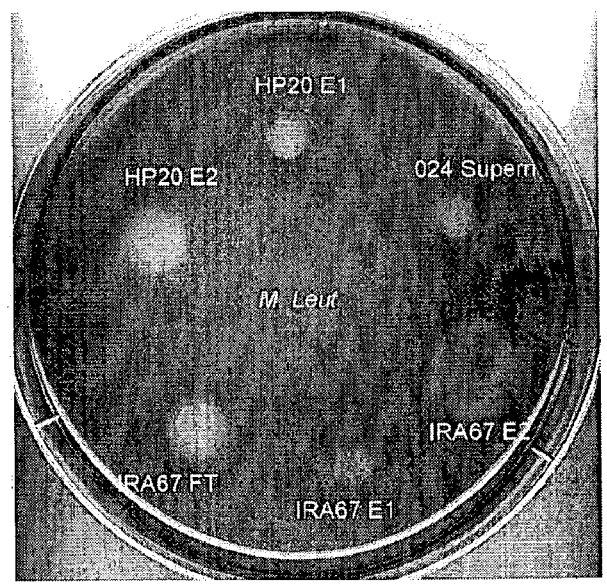
b

Figure 21
a
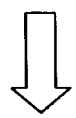
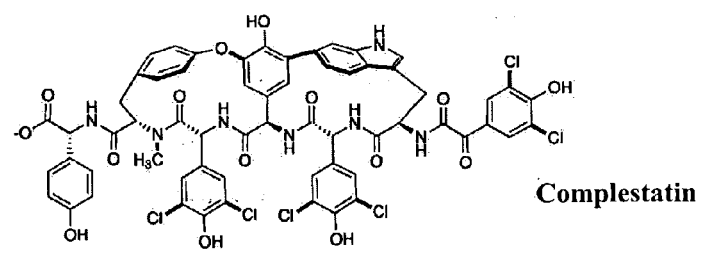
Complestatin
b
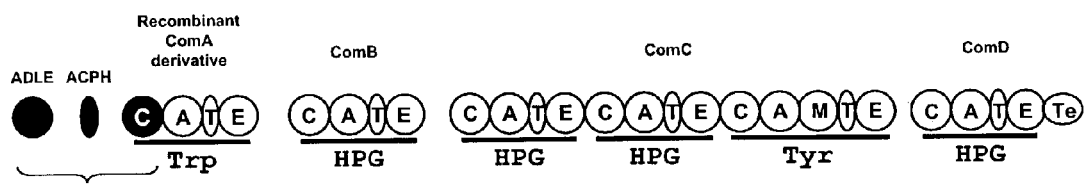
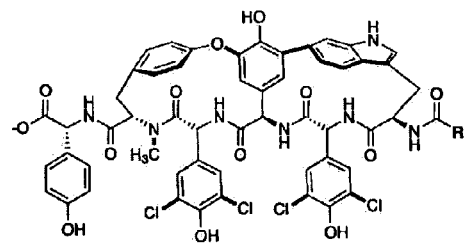
N-acylated Complestatin analogue

Figure 22A

| SEQ ID NO. | Amino acid/ DNA | TYPE | ORF | FAMILY |
|---|---|---|---|---|
| 1. | DNA | Contig 1 |  | A541 |
| 2. | AA | ORF | 1 | A541 |
| 3. | DNA | ORF | 1 | A541 |
| 4. | AA | ORF | 2 | A541 |
| 5. | DNA | ORF | 2 | A541 |
| 6. | DNA | Contig 2 |  | A541 |
| 7. | AA | ORF | 3 | A541 |
| 8. | DNA | ORF | 3 | A541 |
| 9. | AA | ORF | 4 | A541 |
| 10. | DNA | ORF | 4 | A541 |
| 11. | AA | ORF | 5 | A541 |
| 12. | DNA | ORF | 5 | A541 |
| 13. | AA | ORF | 6 | A541 |
| 14. | DNA | ORF | 6 | A541 |
| 15. | AA | ORF | 7 | A541 |
| 16. | DNA | ORF | 7 | A541 |
| 17. | DNA | Contig 3 |  | A541 |
| 18. | AA | ORF | 8 | A541 |
| 19. | DNA | ORF | 8 | A541 |
| 20. | AA | ORF | 9 | A541 |
| 21. | DNA | ORF | 9 | A541 |
| 22. | AA | ORF | 10 | A541 |
| 23. | DNA | ORF | 10 | A541 |

Figure 22B

| 24. | AA | ORF | 11 | A541 |
|---|---|---|---|---|
| 25. | DNA | ORF | 11 | A541 |
| 26. | AA | ORF | 12 | A541 |
| 27. | DNA | ORF | 12 | A541 |
| 28. | AA | ORF | 13 | A541 |
| 29. | DNA | ORF | 13 | A541 |
| 30. | AA | ORF | 14 | A541 |
| 31. | DNA | ORF | 14 | A541 |
| 32. | AA | ORF | 15 | A541 |
| 33. | DNA | ORF | 15 | A541 |
| 34. | | Contig 1 | | 024A |
| 35. | aa | ORF | 1 | 024A |
| 36. | dna | ORF | 1 | 024A |
| 37. | aa | ORF | 2 | 024A |
| 38. | dna | ORF | 2 | 024A |
| 39. | aa | ORF | 3 | 024A |
| 40. | dna | ORF | 3 | 024A |
| 41. | aa | ORF | 4 | 024A |
| 42. | dna | ORF | 4 | 024A |
| 43. | aa | ORF | 5 | 024A |
| 44. | dna | ORF | 5 | 024A |
| 45. | aa | ORF | 6 | 024A |
| 46. | dna | ORF | 6 | 024A |
| 47. | aa | ORF | 7 | 024A |
| 48. | dna | ORF | 7 | 024A |

Figure 22C

| 49. | aa | ORF | 8 | 024A |
|---|---|---|---|---|
| 50. | dna | ORF | 8 | 024A |
| 51. | aa | ORF | 9 | 024A |
| 52. | dna | ORF | 9 | 024A |
| 53. | aa | ORF | 10 | 024A |
| 54. | dna | ORF | 10 | 024A |
| 55. | aa | ORF | 11 | 024A |
| 56. | dna | ORF | 11 | 024A |
| 57. | aa | ORF | 12 | 024A |
| 58. | dna | ORF | 12 | 024A |
| 59. | aa | ORF | 13 | 024A |
| 60. | dna | ORF | 13 | 024A |
| 61. | aa | ORF | 14 | 024A |
| 62. | dna | ORF | 14 | 024A |
| 63. | aa | ORF | 15 | 024A |
| 64. | dna | ORF | 15 | 024A |
| 65. | aa | ORF | 16 | 024A |
| 66. | dna | ORF | 16 | 024A |

GENES AND PROTEINS INVOLVED IN THE BIOSYNTHESIS OF LIPOPEPTIDES

CROSS-REFERENCING TO RELATED APPLICATION

This application claims benefit of provisional application U.S. Ser. No. 60/342,133, filed on Dec. 26, 2001 and of U.S. Ser. No. 60/372,789, filed on Apr. 17, 2002. The application is also a continuation-in-part of U.S. Ser. No. 10/232,370, filed on Sep. 3, 2002. The teachings of the above applications are hereby incorporated by reference in their entirety for all purposes.

FIELD OF INVENTION

The present invention relates to the genes and proteins that direct the synthesis of lipopeptides, in particular the invention relates to the biosynthetic locus for A54145 from *Streptomyces fradiae* ATCC 18158 and the biosynthetic locus for a lipopeptide natural product from *Streptomyces refuineus* NRRL 3143. The present invention also is directed to the use of genes and proteins to produce compounds exhibiting antibiotic activity based on the lipopeptide structure.

BACKGROUND

Lipopeptides are natural products that exhibit potent, broad-spectrum antibiotic activity with a high potential for biotechnological and pharmaceutical applications as antimicrobial, antifungal, or antiviral agents. A single microorganism may produce a mixture of related lipopeptides that differ in the lipid moiety that is attached to the peptide core via a free amine, usually the N-terminal amine of the peptide core. The lipid moiety can have a major influence on the biological properties of lipopeptide natural products. The A54145 antibiotics produced by *S. fradiae* are a group of lipopeptides comprising at least eight microbiologically active, related factors A, $A_1$, B, $B_1$, C, D, E, and F. Each A54145 factor bears a cyclic 13-amino acid, acidic polypeptide core and a fatty acyl group attached to the N-terminal amine. The eight A54145 factors differ in the identity of the amino acid residue at position 12 and 13 of the peptide core, as well as the identity of the fatty acid (see FIG. 1).

Many low molecular weight peptides produced by bacteria are synthesized nonribosomally on large multifunctional proteins termed nonribosomal peptide synthetases (NRPSs) (Doekel and Marahiel, 2001, Metabolic Engineering, Vol. 3, pp. 64–77). NRPSs are modular proteins that consist of one or more polyfunctional polypeptides each of which is made up of modules. The amino-terminal to carboxy-terminal order and specificities of the individual modules correspond to the sequential order and identity of the amino acid residues of the peptide product. Each NRPS module recognizes a specific amino acid substrate and catalyzes the stepwise condensation to form a growing peptide chain. The identity of the amino acid recognized by a particular unit can be determined by comparison with other units of known specificity (Challis and Ravel, 2000, FEMS Microbiology Letters, Vol. 187, pp. 111–114). In many peptide synthetases, there is a strict correlation between the order of repeated units in a peptide synthetase and the order in which the respective amino acids appear in the peptide product, making it possible to correlate peptides of known structure with putative genes encoding their synthesis, as demonstrated by the identification of the mycobactin biosynthetic gene cluster from the genome of *Mycobacterium tuberculosis* (Quadri et al., 1998, Chem. Biol. Vol. 5, pp. 631–645).

The modules of a peptide synthetase are composed of smaller units or "domains" that each carry out a specific role in the recognition, activation, modification and joining of amino acid precursors to form the peptide product. One type of domain, the adenylation (A) domain, is responsible for selectively recognizing and activating the amino acid that is to be incorporated by a particular unit of the peptide synthetase. This activation step is ATP-dependent and involves the transient formation of an amino-acyl-adenylate. The activated amino acid is covalently attached to the peptide synthetase through another type of domain, the thiolation (T) domain, that is generally located adjacent to the A domain. The T domain is post-translationally modified by the covalent attachment of a phosphopantetheinyl prosthetic arm to a conserved serine residue. The activated amino acid substrates are tethered onto the nonribosomal peptide synthetase via a thioester bond to the phosphopantetheinyl prosthetic arm of the respective T domains. Amino acids joined to successive units of the peptide synthetase are subsequently covalently linked together by the formation of amide bonds catalyzed by another type of domain, the condensation (C) domain. NRPS modules can also occasionally contain additional functional domains that carry out auxiliary reactions, the most common being epimerization of an amino acid substrate from the L- to the D-form. This reaction is catalyzed by a domain referred to as an epimerization (E) domain that is generally located adjacent to the T domain of a given NRPS module. Thus, a typical NRPS module has the following domain organization: C-A-T-(E).

Product assembly by NRPSs involves three distinct phases, namely chain initiation, chain elongation, and chain termination (Keating and Walsh, 1999, Curr. Opin. Chem. Biol., Vol 3, pp. 598–606). Polypeptide chain initiation is carried out by specialized modules termed "starter modules" that comprise an A domain and a T domain. Elongation modules have, in addition, a C domain that is located upstream of the A domain. It has been experimentally demonstrated that such elongation domains cannot initiate peptide bond formation due to interference by the C domain (Linne and Marahiel, 2000, Biochemistry, Vol. 39, pp. 10439–10447). All the growing peptide intermediates are covalently tethered to the NRPS during translocations as an elongating series of acyl-S-enzyme intermediates. To release the mature peptide product from the NRPS, the terminal acyl-S-enzyme bond must be broken. This process is the chain termination step and is usually catalyzed by a C-terminal thioesterase (TE) domain. Thioesterase-mediated release of the mature peptide from the NRPS enzyme involves the transient formation of an acyl-O-TE intermediate that is then hydrolyzed or hydrolyzed and concomitantly cyclized to release the mature peptide (Keating et al., 2001, Chembiochem, Vol. 2, pp. 99–107).

SUMMARY OF THE INVENTION

The present invention advantageously provides genes and proteins involved in the production of lipopeptides. Specific embodiments of the genes and proteins are provided in the accompanying sequence listing. SEQ ID NOS: 3, 5, 8,10, 12, 14, 16, 19, 21, 23, 25, 27, 29, 31, 33 provide nucleic acids responsible for biosynthesis of the lipopeptide A54145. SEQ ID NOS: 2, 4, 7, 9, 11, 13, 15, 18, 20, 22, 24, 26, 28, 30 and 32 provide amino acid sequences for proteins responsible for biosynthesis of the lipopeptide A54145. SEQ ID NOS: 36, 38, 40, 42, 44, 46, 48, 50, 52, 54, 56, 58, 60, 62, 64, 66 provide nucleic acid sequences for genes responsible for biosynthetisis of an A54145-like lipopeptide. SEQ ID NOS: 35, 37, 39, 41, 43, 45, 47, 49, 51, 53, 55, 57, 59, 61, 63, 65 provide amino acid sequences for proteins responsible for biosynthesis of the A54145-like lipopeptide. The genes and proteins of the invention provide the machinery for producing novel lipopeptide-related compounds based on A54145 compounds.

The invention discloses NRPS genes, namely A541 ORF 2, 3, 4, 5 and 6 (SEQ ID NOS: 5, 8, 10, 12 and 14) and 024A ORFS 4, 5, 6 and 7 (SEQ ID NOS: 42, 44, 46 and 48) and their corresponding gene products SEQ ID NOS: 4, 7, 9, 11, 13, 41, 43, 45 and 47 respectively) that can be used to produce a variety of lipopeptides, some of which are now produced only by fermentation, others of which are now produced by fermentation and chemical modification, and still others of which are novel lipopeptides which are now not produced either by fermentation or chemical modification. The invention allows direct manipulation of A54145 and related chemical structures via chemical engineering of the enzymes of A541 and 024A, modifications which are presently not possible by chemical methodology because of complexity of the structures.

The invention can also be used to introduce "chemical handles" into normally inert positions that permit subsequence chemical modifications. Several general approaches to achieve the development of novel lipopeptides are facilitated by the methods and reagents of the present invention. For example, molecular modeling can be used to predict optimal structures. Various polypeptide structures can be generated by genetic manipulation of A541 and 024A gene cluster in accordance with the methods of the invention. The invention can be used to generate a focused library of analogs around a lipopeptide lead candidate to fine-tune the compound for optimal properties. Genetic engineering methods of the invention can be directed to modify positions of the molecule previously inert to chemical modifications. Known techniques allow one to manipulate a known NRPS gene cluster either to produce the lipopeptide synthesized by that NRPS at higher levels than occur in nature or in hosts that otherwise do not produce the lipopeptide. Known techniques allow one to produce molecules that are structurally related to, but distinct from the lipopeptides produced from known lipopeptide gene clusters.

Thus the invention provides an isolated, purified or enriched nucleic acid comprising a nucleic acid sequence selected from the group consisting of: (a) SEQ ID NOS: 1, 6, and 17 and coding regions thereof; (b) a nucleic acid having at least 75% identity to a nucleic acid of (a); and (c) a nucleic acid complementary to a nucleic acid of (a) or (b). In a related aspect, the invention provides a nucleic acid selected from the group consisting of: (a) a nucleic acid of SEQ ID NOS: 3, 5, 8, 10, 12, 14, 16, 19, 21, 23, 25, 27, 29, 31, 33; (b) a nucleic acid encoding a polypeptide of SEQ ID NOS: 2, 4, 7, 9, 11, 13, 15, 18, 20, 22, 24, 26, 28, 30, 32; (c) a nucleic acid having at least 75% homology to a nucleic acid of (a) or (b); and (d) a nucleic acid complementary to a nucleic acid of (a), (b) or (c). In a further aspect, the invention provides an isolated, purified or enriched nucleic acid capable of hybridizing to the above nucleic acids under conditions of high stringency. In one embodiment, the nucleic acid comprises the sequence of at least two nucleic acids of the above nucleic acids. In another embodiment, the nucleic acid comprises the sequence of at least three of the above nucleic acids.

The invention also provides an isolated, purified or enriched nucleic acid that hybridizes under stringent conditions to any one of A541 ORFs 1, 2, 3, 4, 5, 6, 7, 8, 9, 10, 11, 12, 13, 14 or 15 (SEQ ID NOS: 3, 5, 8, 10, 12, 14, 16, 19, 21, 23, 25, 27, 29, 31, 33) and can substitute for the ORF to which it specifically hybridizes to direct the synthesis of an A54145 compound or analogue.

The invention also provides an isolated gene cluster comprising ORFs encoding polypeptides sufficient to direct the synthesis of an A54145 compound or analogue. In one embodiment, the isolated gene cluster is present in a bacterium. In another embodiment, the isolated gene cluster contains a nucleic acid of any one of A541 ORFs 1 to 15 (SEQ ID NOS: 3, 5, 8, 10, 12, 14, 16, 19, 21, 23, 25, 27, 29, 31, 33) present in the *E. coli* strains DH10B having accession nos. IDAC 260202-1, 260202-2 and 260202-3.

The invention also provides an isolated polypeptide comprising a polypeptide sequence selected from any one of: (a) a polypeptide of any one of SEQ ID NOS: 2, 4, 7, 9, 11, 13, 15, 18, 20, 22, 24, 26, 28, 30, 32; and (b) a polypeptide which is at least 75% identical in amino acid sequence to a polypeptide of any one of SEQ ID NOS: 2, 4, 7, 9, 11, 13, 15, 18, 20, 22, 24, 26, 28, 30, 32. In one embodiment, the polypeptide comprises at least two of the above polypeptides. In another embodiment, the polypeptide comprises at least three of the above polypeptides. In still another embodiment, the polypeptide comprises at least five or more of the above polypeptides.

The invention also provides an expression vector comprising the above nucleic acids. In a related aspect, the invention provides a host cell transformed with the expression vector. In one embodiment the host cell is transformed with an exogenous nucleic acid comprising a gene cluster encoding polypeptides sufficient to direct the assembly of an A54145 compound or analogue.

The invention provides a method of chemically modifying a biological molecule that is a substrate for a polypeptide encoded by a gene product of A541 ORFs 1 to 15 comprising contacting the biological molecule with a gene product of A541 ORF 1 to 15, wherein said polypeptide chemically modifies said biological molecule. In another aspect, the invention provides a method of chemically modifying a biological molecule that is a substrate for a polypeptide encoded by an A54145 biosynthesis gene cluster, said method comprising contacting the biological molecule with at least two different polypeptides described above.

The invention also provides an isolated or purified antibody capable of specifically binding to a polypeptide having a sequence selected from the group consisting of SEQ ID NOS: 2, 4, 7, 9, 11, 13, 15, 18, 20, 22, 24, 26, 28, 30, 32. The invention provides a method of making a polypeptide having a sequence selected from the group consisting of SEQ ID NOS: 2, 4, 7, 9, 11, 13, 15, 18, 20, 22, 24, 26, 28, 30, 32 comprising introducing a nucleic acid encoding said polypeptide, said nucleic acid being operably linked to a promoter, into a host cell. The invention also provides a method of making a A54145 compound or analog comprising the step of providing a bacterium containing a gene cluster with sufficient genes to produce a A54145 compound or analogue and culturing the bacterium under conditions allowing for expression of the sufficient genes to produce an A54145 compound, wherein the gene cluster contains at least one of the nucleic acids referred to above. In one embodiment the method comprising culturing a *Streptomyces fradiae* bacterium under conditions allowing for expression of A541 ORFs 1 to 15 (SEQ ID NOS: 3, 5, 8, 10, 12, 14, 16, 19, 21, 23, 25, 27, 29, 31, 33) present in the *E. coli* strains DH10B having accession nos. IDAC 260202-1, 260202-2 and 260202-3.

Thus the invention provides an isolated, purified or enriched nucleic acid comprising a nucleic acid sequence selected from the group consisting of: (a) SEQ ID NO: 34, and coding regions thereof; (b) a nucleic acid having at least 75% identity to a nucleic acid of (a); and (c) a nucleic acid complementary to a nucleic acid of (a) or (b). In a related aspect, the invention provides a nucleic acid selected from the group consisting of: (a) a nucleic acid of SEQ ID NOS: 36, 38, 40, 42, 44, 46, 48, 50, 52, 54, 56, 58, 60, 62, 64 and 66; (b) a nucleic acid encoding a polypeptide of SEQ ID NOS: 35, 37, 39, 41, 43, 45, 47, 49, 51, 53, 55, 57, 59, 61, 63, and 65; (c) a nucleic acid having at least 75% homology to a nucleic acid of (a) or (b); and (d) a nucleic acid complementary to a nucleic acid of (a), (b) or (c). In a further aspect, the invention provides an isolated, purified or enriched nucleic acid capable of hybridizing to the above nucleic acids under conditions of high stringency. In one embodiment, the nucleic acid comprises the sequence of at least two nucleic acids of the above nucleic acids. In another embodiment, the nucleic acid comprises the sequence of at least three of the above nucleic acids.

The invention also provides an isolated, purified or enriched nucleic acid that hybridizes under stringent conditions to any one of 024A ORFs 1, 2, 3, 4, 5, 6, 7, 8, 9, 10, 11, 12, 13, 14, 15 or 16 (SEQ ID NOS: 36, 38, 40, 42, 44, 46, 48, 50, 52, 54, 56, 58, 60, 62, 64 and 66) and can substitute for the ORF to which it specifically hybridizes to direct the synthesis of an A54145-like compound or analogue.

The invention also provides an isolated gene cluster comprising ORFs encoding polypeptides sufficient to direct the synthesis of an 024A A54145-like compound or analogue. In one embodiment, the isolated gene cluster is present in a bacterium. In another embodiment, the isolated gene cluster contains a nucleic acid of any one of 024A ORFs 1 to 16 (SEQ ID NOS: 36, 38, 40, 42, 44, 46, 48, 50, 52, 54, 56, 58, 60, 62, 64 and 66) present in the *E. coli* strains DH10B having accession nos. IDAC 260202-4 and IDAC 260202-5.

The invention also provides an isolated polypeptide comprising a polypeptide sequence selected from any one of: (a) a polypeptide of any one of SEQ ID NOS: 35, 37, 39, 41, 43, 45, 47, 49, 51, 53, 55, 57, 59, 61, 63, and 65; and (b) a polypeptide which is at least 75% identical in amino acid sequence to a polypeptide of any one of SEQ ID NOS: 35, 37, 39, 41, 43, 45, 47, 49, 51, 53, 55, 57, 59, 61, 63, and 65. In one embodiment, the polypeptide comprises at least two of the above polypeptides. In another embodiment, the polypeptide comprises at least three of the above polypeptides. In still another embodiment, the polypeptide comprises at least five or more of the above polypeptides.

The invention also provides an expression vector comprising one of the above nucleic acids. In a related aspect, the invention provides a host cell transformed with the expression vector. In one embodiment the host cell is transformed with an exogenous nucleic acid comprising a gene cluster encoding polypeptides sufficient to direct the assembly of an 024A A54145-like compound or analogue.

The invention provides a method of chemically modifying a biological molecule that is a substrate for a polypeptide encoded by a gene product of 024A ORFs 1 to 16 (SEQ ID NOS: 35, 37, 39, 41, 43, 45, 47, 49, 51, 53, 55, 57, 59, 61, 63 and 65) comprising contacting the biological molecule with a gene product of 024A ORF 1 to 16 (SEQ ID NOS: 35, 37, 39, 41, 43, 45, 47, 49, 51, 53, 55, 57, 59, 61, 63 and 65), wherein said polypeptide chemically modifies said biological molecule. In another aspect, the invention provides a method of chemically modifying a biological molecule that is a substrate for a polypeptide encoded by an 024A biosynthesis gene, said method comprising contacting the biological molecule with at least two of the above polypeptides.

The invention also provides an isolated or purified antibody capable of specifically binding to a polypeptide having a sequence selected from the group consisting of SEQ ID NOS: 35, 37, 39, 41, 43, 45, 47, 49, 51, 53, 55, 57, 59, 61, 63, and 65. The invention provides a method of making a polypeptide having a sequence selected from the group consisting of SEQ ID NOS: 35, 37, 39, 41, 43, 45, 47, 49, 51, 53, 55, 57, 59, 61, 63, and 65 comprising introducing a nucleic acid encoding said polypeptide, said nucleic acid being operably linked to a promoter, into a host cell. The invention also provides a method of making a 024A compound or analog comprising the step of providing a bacterium containing a gene cluster with sufficient genes to produce a 024A compound or analogue and culturing the bacterium under conditions allowing for expression of the sufficient genes to produce a 024A compound, wherein the gene cluster contains at least one of the 024A nucleic acids. In one embodiment the method comprises culturing a *Streptomyces* bacterium under conditions allowing for expression of A541 ORFs 1 to 15 (SEQ ID NOS: 3, 5, 8, 10, 12, 14, 16, 19, 21, 23, 25, 27, 29, 31, 33) present in the *E. coli* strains DH10B having accession nos. IDAC 260202-1, 260202-2 and 260202-3.

BRIEF DESCRIPTION OF THE DRAWINGS

The present invention will be further understood from the following description with reference to the following figures:

FIGS. 3a, 3b and 3c are an amino acid alignment of C-domains from A541 ORFs 2, 3, 4, 5 and 6 (SEQ ID NOS: 4, 7, 9, 11 and 13) highlighting conserved motifs characteristic of condensation domains. In this and other amino acid alignments of the specification, a line above the alignement is used to mark strongly conserved positions. In addition, three characters, namely * (asterisk), : (colon) and . (period) are used, wherein "*" indicates positions which have a single, fully conserved residue; ":" indicates that one of the following strong groups is fully conserved: STA, NEQK, NHQK, NDEQ, QHRK, MILV, MILF, HY, and FYW; and "." Indicates that one of the following weaker groups is fully conserved: CSA, ATV, SAG, STNK, STPA, SGND, SNDEQK, NDEQHK, NEQHRK, FVLIM, and HFY.

FIGS. 4a, 4b, 4c, 4d and 4e are an amino acid alignment of A-domains and an A/N-methyltransferase domain fusion from A541 ORFs 2, 3, 4, 5 and 6 (SEQ ID NOS: 4, 7, 9, 11 and 13) highlighting conserved motifs characteristic of adenylation domains and methyltransferase motifs.

FIG. 5 is an amino acid alignment of T domains from A541 ORF 2, 3, 4, 5 and 6 (SEQ ID NOS: 4, 7, 9, 11 and 13) highlighting the conserved residue of the thiolation domain to which a phosphopantetheine group is covalently attached post-translationally.

FIG. 6 is an amino acid alignment of E-domains from A541 ORFs 2 and 5 (SEQ ID NOS: 4 and 11) highlighting conserved motifs characteristic of epimerization domains.

FIG. 7 is an amino acid alignment of Te domain from A541 ORF 6 (SEQ ID NO: 13) as compared with the corresponding sequence in CADA highlighting the conserved residues characteristic of thioesterase domains.

FIGS. 8a, 8b and 8c is an amino acid alignment of C-domains in the 024A ORFs 4, 5, 6 and 7 (SEQ ID NOS: 41, 43, 45 and 47) highlighting conserved motifs characteristic of condensation domains.

FIGS. 9a, 9b, 9c, 9d and 9e is an amino acid alignment of A-domains and an A-domain having an insertion of an N-methyltransferase domain from 024A ORFs 4, 5, 6 and 7 (SEQ ID NOS: 41, 43, 45 and 47) highlighting conserved motifs characteristic of adenylation domains and methyltransferase motifs.

FIG. 10 is an amino acid alignment of T domains from 024A ORFs 4, 5, 6 and 7 (SEQ ID NOS: 41, 43, 45 and 47) highlighting the conserved residue of the thiolation domain to which a phosphopantetheine group is covalently attached post-translationally.

FIG. 11 is an amino acid alignment of E-domains in 024A ORFs 4 and 6 (SEQ ID NOS: 41 and 45) highlighting conserved motifs characteristic of epimerization domains.

FIG. 12 is an amino acid alignment of Te domain from 024A ORF 7 (SEQ ID NO: 47) as compared with the corresponding sequence in CADA highlighting the conserved residues characteristic of thioesterase domains.

FIGS. 14a and 14b is an amino acid alignment of ADLE proteins from 024A ORF 2 (SEQ ID NO: 37), A541 ORF 1 (SEQ ID NO: 2) and the ADLE proteins from RAMO, DAPT and A410, highlighting conserved motifs of acyl CoA ligases. For SEQ ID NO: 2 only amino acid residues for 1 to 648 corresponding to the ADLE domain were used in the alignment.

FIG. 15 is an amino acid alignment of ACPH proteins from 024A ORF 3 (SEQ ID NO: 39), A541 ORF 1 (SEQ ID NO: 2) and the ACPH proteins from RAMO, DAPT, A410, highlighting conserved serine residues of the thiolation domain to which a phosphopantetheine group is covalently attached post-translationally. For SEQ ID NO: 2 only amino acids reidues for 649 to 723 corresponding to the ACPH domain were used for the alignment.

FIGS. 17a and 17b is an amino acid alignment of the unusual (acyl-specific) N-terminal C-domain from NRSPs of 024A ORF 4 (SEQ ID NO: 41), A541 ORF 2 (SEQ ID NO: 4), and the acyl-specific C-domains from NRPSs of RAMO, DAPT and A410, highlighting conserved motifs.

FIG. 19 is an amino acid alignment of the MTFZ C-methytransferase from 024A ORF 16 (SEQ ID NO: 65) and A541 ORF 15 (SEQ ID NO: 32) and the MTFZ C-methytransferase from DAPT and CADA, which MTFZ C-methytransferases are involved in generating the 3-methyl-glutamate residue of A54145, the lipopeptide of 024A, A-21978C (daptomycin), and "calcium-dependent antibiotic" of S. coelicolor respectively. Conserved methyl transferase motifs are highlighted.

FIGS. 20a and 20b are photographs of plates generated in the bioassay of anionic lipopeptide isolation experiments described herein, which plates illustrate an enrichment of activity, based on IRA67 anion exchange chromatography of lipopeptides from Streptomyces fradiae and Streptomyces refuineus subsp. thermotolerans.

FIG. 21a illustrates use of NRPS biosynthetic machinery of a nonlipopeptide natural product, complestatin, to produce an N-acylated analogue of complestatin. FIG. 21b illustrates a rationally designed recombinant NRPS system that gives rise to N-acylated complestatin analogue(s).

FIG. 22 is a chart showing the ORFs and contigs according to some embodiments of the invention.

DETAILED DESCRIPTION OF THE INVENTION

Figure 1:
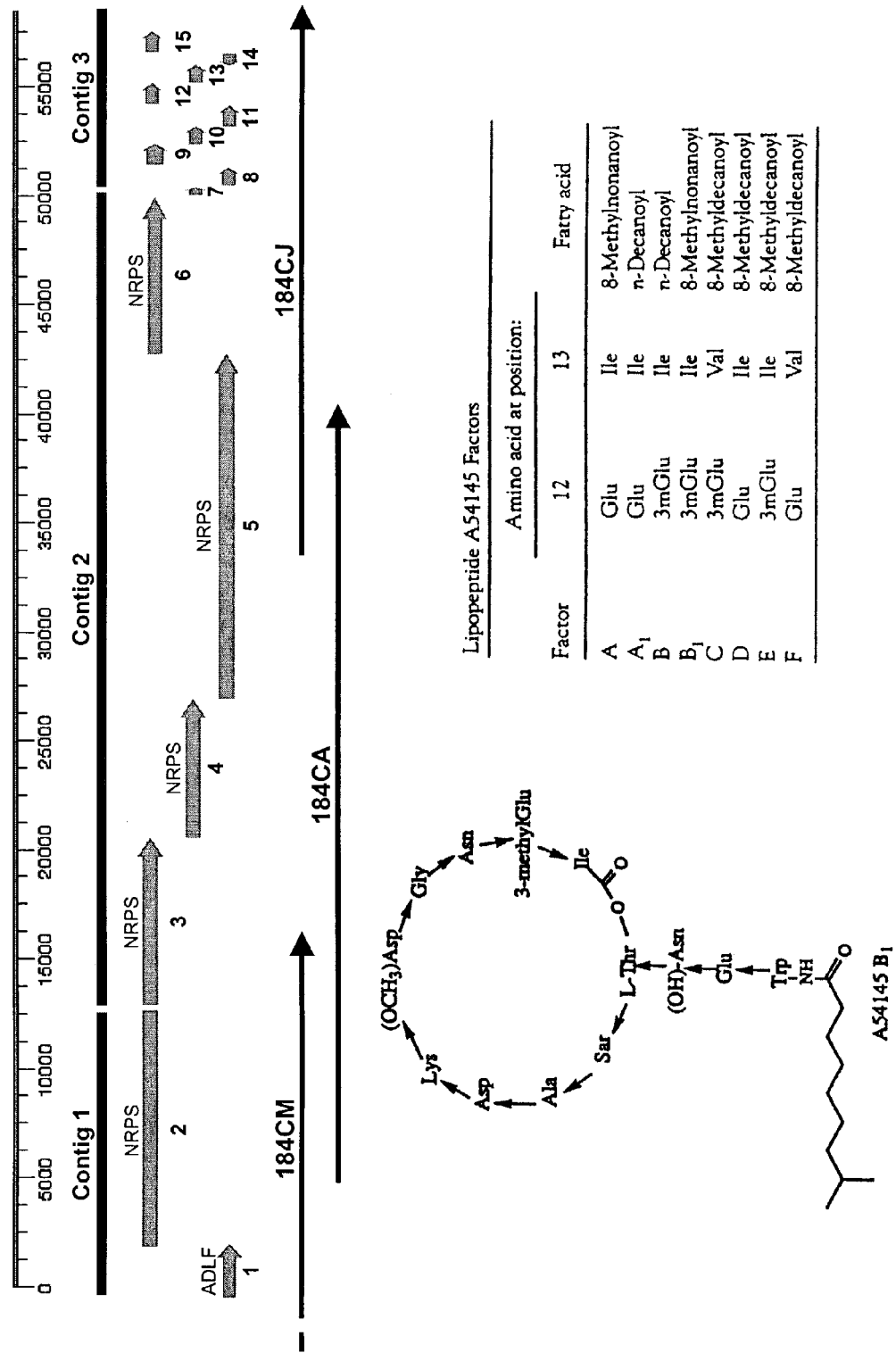
FIG. 1 is a graphical depiction of the A541 biosynthetic locus from *Streptomyces fradiae* ATCC 18158 showing, at the top of the figure, a scale in base pairs; followed by the coverage of the locus by the three continuous DNA sequences (SEQ ID NO: 1, 6 and 17); the relative positioning and orientation of the 15 ORFs referred to by ORF number (SEQ ID NOS: 3, 5, 8, 10, 13, 14, 16, 19, 21, 23, 25, 27, 29, 31 and 33 respectively); the regions of the locus covered by the deposited cosmid clones 184CM, 184CA and 184CJ; and the structure of an A54145 compound and all A54145 factors produced by A541.

Throughout the description and the figures, the biosynthetic locus for A54145 from Streptomyces fradiae ATCC 18158 is sometimes referred to as "A541" and the biosynthetic locus for a lipopeptide natural product from Streptomyces refuineus NRRL 3143 is sometimes referred to as "024A". In addition, reference is sometimes made in description and in the figures to other lipopeptide biosynthetic loci, wherein "RAMO" refers to the biosynthetic locus for ramoplanin from Actinoplanes sp. ATCC 33076, "DAPT" refers to the biosynthetic locus for A21978C from Streptomyces roseosporus NRRL 11379, "A410" refers to the biosynthetic locus for a lipopeptide natural product from Actinoplanes nipponensis FD 24834 ATCC 31145, and "CADA" refers to the biosynthetic locus for the calcium-dependent antibiotic from Streptomyces coelicolor A3(2) (Bentley et al., 2002, Nature, vol. 417, pp 141–147).

The ORFs in A541 and 024A are assigned a putative function sometimes referred to throughout the description and figures by reference to a four-letter designation, as indicated in Table I.

TABLE 1

Family Descriptions

| Families | Proposed Function |
|---|---|
| ABCD | ABC transporter; ATP-binding cassette transmembrane transporter; includes proteins with similarity to Mdr |

TABLE 1-continued

Family Descriptions

| Families | Proposed Function |
|---|---|
| | proteins of mammalian tumor cells that confer resistance to daunorubicin, doxorubicin and some other structurally unrelated chemotherapeutic agents; DrrA-type proteins cooperate with a transmembrane component to confer resistance |
| ACPH | acyl carrier protein, unusual |
| ADLE | similar to acyl-CoA ligase, involved in fatty acyl transfer; usually associated with a free acyl carrier protein |
| ADLF | natural fusion of ADLE and ACPH; acylCoA ligase activates and tethers fatty acids |
| EATB | esterase/acetyltransferase/lipase/haloperoxidase; alpha/beta hydrolase fold; includes aryl esterases, bifunctional enzymes capable of both ester hydrolysis and halogenation, act on many phenolic esters |
| MEMD | membrane protein; includes DrrB daunorubicin resistance transmembrane protein and related proteins that act with an ABCD component to confer resistance |
| MEMT | membrane protein |
| MTAG | methyltransferase |
| MTFZ | Structurally related to the ubiE/COQ5 family of C-methyltransferases (pfam01209). Apart from the ubiquinone/menaquinone biosynthesis C-methyltransferases, this family also includes other methyltransferases involved in biotin and sterol biosynthesis and in phosphatidylethanolamine methylation. |
| OXAB | oxidoreductase, putative; weak homology to alpha-ketoglutarate dependent dioxygenases. |
| OXAU | oxidoreductase, flavoprotein-dependent; homology to acyl CoA dehydrogenases; possibly membrane-associated; includes proteins that may be responsible for generating the unsaturated fatty acyl moiety of ramoplanin. |
| OXDD | putative oxygenase, domain homology to clavaminate synthases Cas1, Cas2 |
| PPST/NRPS | non-ribosomal peptide synthetase |
| UNKC | unknown; includes MbtH involved in mycobactin synthesis; usually associated with non-ribosomal peptide synthetases;; may be an unusual ACP |

The terms "lipopeptide producer" and "lipopeptide-producing organism" refer to a microorganism that carries the genetic information necessary to produce a lipopeptide compound, whether or not the organism is known to produce a lipopeptide compound. The terms apply equally to organisms in which the genetic information to produce the lipopeptide compound is found in the organism as it exists in its natural environment, and to organisms in which the genetic information is introduced by recombinant techniques. For the sake of particularity, specific organisms contemplated herein include organisms of the family Micromonosporaceae, of which preferred genera include *Micromonospora, Actinoplanes* and *Dactylosporangium*; the family Streptomycetaceae, of which preferred genera include *Streptomyces* and *Kitasatospora*; the family Pseudonocardiaceae, of which preferred genera are *Amycolatopsis* and *Saccharopolyspora*; and the family Actinosynnemataceae, of which preferred genera include *Saccharothrix* and *Actinosynnema*; however the terms are intended to encompass all organisms containing genetic information necessary to produce a lipopeptide compound.

The term lipopeptide biosynthetic gene product refers to any enzyme or polypeptide involved in the biosynthesis of lipopeptide product. For the sake of particularity, the lipopeptide biosynthetic pathways are associated with *Streptomyces fradiae* in the case of A541 and with *Streptomyces refuineus* in the case of 024A. However, it should be understood that this term encompasses lipopeptide biosynthetic enzymes (and genes encoding such enzymes) isolated from any microorganism of the genus *Streptomyces*, and furthermore that these genes may have novel homologues in related actinomycete microorganisms or non-actinomycete microorganisms that fall within the scope of the invention. Representative lipopeptide biosynthetic gene products include the polypeptides listed in SEQ ID NOS: 2, 4, 7, 9, 11, 13, 15, 18, 20, 22, 24, 26, 28, 30, 32 and 35, 37, 39, 41, 43, 45, 47, 49, 51, 53, 55, 57, 59, 61, 63, 65 or homologues thereof.

The term "isolated" means that the material is removed from its original environment, e.g. the natural environment if it is naturally-occurring. For example, a naturally-occurring polynucleotide or polypeptide present in a living organism is not isolated, but the same polynucleotide or polypeptide, separated from some or all of the coexisting materials in the natural system, is isolated. Such polynucleotides could be part of a vector and/or such polynucleotides or polypeptides could be part of a composition, and still be isolated in that such vector or composition is not part of its natural environment.

The term "purified" does not require absolute purity; rather, it is intended as a relative definition. Individual nucleic acids obtained from a library have been conventionally purified to electrophoretic homogeneity. The purified nucleic acids of the present invention have been purified from the remainder of the genomic DNA in the organism by at least $10^4$ to $10^6$ fold. However, the term "purified" also includes nucleic acids which have been purified from the remainder of the genomic DNA or from other sequences in a library or other environment by at least one order of magnitude, preferably two or three orders of magnitude, and more preferably four or five orders of magnitude.

"Recombinant" means that the nucleic acid is adjacent to "backbone" nucleic acid to which it is not adjacent in its natural environment. "Enriched" nucleic acids represent 5% or more of the number of nucleic acid inserts in a population of nucleic acid backbone molecules. "Backbone" molecules include nucleic acids such as expression vectors, self-replicating nucleic acids, viruses, integrating nucleic acids, and other vectors or nucleic acids used to maintain or manipulate a nucleic acid of interest. Preferably, the enriched nucleic acids represent 15% or more, more preferably 50% or more, and most preferably 90% or more, of the number of nucleic acid inserts in the population of recombinant backbone molecules.

"Recombinant" polypeptides or proteins refer to polypeptides or proteins produced by recombinant DNA techniques, i.e. produced from cells transformed by an exogenous DNA construct encoding the desired polypeptide or protein. "Synthetic" polypeptides or proteins are those prepared by chemical synthesis.

The term "gene" means the segment of DNA involved in producing a polypeptide chain; it includes regions preceding and following the coding region (leader and trailer) as well as, where applicable, intervening regions (introns) between individual coding segments (exons).

A DNA or nucleotide "coding sequence" or "sequence encoding" a particular polypeptide or protein, is a DNA sequence which is transcribed and translated into a polypeptide or protein when placed under the control of appropriate regulatory sequences.

"Oligonucleotide" refers to a nucleic acid, generally of at least 10, preferably 15 and more preferably at least 20 nucleotides, preferably no more than 100 nucleotides, that are hybridizable to a genomic DNA molecule, a cDNA molecule, or an mRNA molecule encoding a gene, mRNA, cDNA or other nucleic acid of interest.

A promoter sequence is "operably linked to" a coding sequence recognized by RNA polymerase which initiates transcription at the promoter and transcribes the coding sequence into mRNA.

Bacteria and many eukaryotes have a coordinated mechanism for regulating genes whose products are involved in related processes. The genes are clustered, in structures referred to as "gene clusters," on a single chromosome and are transcribed together, e.g., under the control of a single regulatory sequence, including a single promoter which initiates transcription of the entire cluster. The gene cluster, the promoter, and additional sequences that function in regulation altogether are referred to as an "operon" and can include up to 20 or more genes, usually from 2 to 6 genes. Thus, a gene cluster is a group of adjacent genes that are either identical or related, usually as to their function. In the present invention, a "gene cluster" contains related genes involved in the biosynthesis of lipopolypeptides.

"Plasmids" are designated herein by a lower case p preceded or followed by capital letters and/or numbers. The starting plasmids herein are commercially available, publicly available on an unrestricted basis, or can be constructed from available plasmids in accord with published procedures. In addition, equivalent plasmids to those described herein are known in the art and will be apparent to the skilled artisan.

"Digestion" of DNA refers to enzymatic cleavage of the DNA with a restriction enzyme that acts only at certain sequences in the DNA. The various restriction enzymes used herein are commercially available and their reaction conditions, cofactors and other requirements were used as would be known to the ordinary skilled artisan. For analytical purposes, typically 1 µg of plasmid or DNA fragment is used with about 2 units of enzyme in about 20 µl of buffer solution. For the purpose of isolating DNA fragments for plasmid construction, typically 5 to 50 µg of DNA are digested with 20 to 250 units of enzyme in a larger volume. Appropriate buffers and substrate amounts for particular enzymes are specified by the manufacturer. Incubation times of about 1 hour at 37° C. are ordinarily used, but may vary in accordance with the supplier's instructions. After digestion the gel electrophoresis may be performed to isolate the desired fragment.

We have now discovered the genes and proteins involved in the biosynthesis of the lipopeptide A54145. Nucleic acid sequences encoding proteins involved in the biosynthesis of the A54145 compound are provided in the accompanying sequence listing as SEQ ID NOS: 3, 5, 8, 10, 12, 14, 16, 19, 21, 23, 25, 27, 29, 31, 33. Polypeptides involved in the biosynthesis of the A54145 compound are provided in the accompanying sequence listing as SEQ ID NOS: 2, 4, 7, 9, 11, 13, 15, 18, 20, 22, 24, 26, 28, 30, 32.

We have also discovered the genes and proteins involved in the biosynthesis of an A54145-like compound from an organism not previously reported to produce a lipopeptide. Nucleic acid sequences encoding proteins involved in the biosynthesis of the A54145-like compound are provided in the accompanying sequence listing as SEQ ID NOS: 36, 38, 40, 42, 44, 46, 48, 50, 52, 54, 56, 58, 60, 62, 64, 66. Polypeptides involved in the biosynthesis of the A54145-like compound are provided in the accompanying sequence listing as SEQ ID NOS: 35, 37, 39, 41, 43, 45, 47, 49, 51, 53, 55, 57, 59, 61, 63, 65.

One aspect of the present invention is an isolated, purified, or enriched nucleic acid comprising one of the sequences of SEQ ID NOS: 3, 5, 8, 10, 12, 14, 16, 19, 21, 23, 25, 27, 29, 31, 33 and 36, 38, 40, 42, 44, 46, 48, 50, 52, 54, 56, 58, 60, 62, 64, 66, the sequences complementary thereto, or a fragment comprising at least 100, 200, 300, 400, 500, 600, 700, 800 or more consecutive bases of one of the sequences of SEQ ID NOS: 3, 5, 8, 10, 12, 14, 16, 19, 21, 23, 25, 27, 29, 31, 33 and 36, 38, 40, 42, 44, 46, 48, 50, 52, 54, 56, 58, 60, 62, 64, 66 or the sequences complementary thereto. The isolated, purified or enriched nucleic acids may comprise DNA, including cDNA, genomic DNA, and synthetic DNA. The DNA may be double stranded or single stranded, and if single stranded may be the coding (sense) or non-coding (anti-sense) strand. Alternatively, the isolated, purified or enriched nucleic acids may comprise RNA.

As discussed in more detail below, the isolated, purified or enriched nucleic acids of one of SEQ ID NOS: 3, 5, 8, 10, 12, 14, 16, 19, 21, 23, 25, 27, 29, 31, 33 and 36, 38, 40, 42, 44, 46, 48, 50, 52, 54, 56, 58, 60, 62, 64, 66 may be used to prepare one of the polypeptides of SEQ ID NOS: 2, 4, 7, 9, 11, 13, 15, 18, 20, 22, 24, 26, 28, 30, 32 and 35, 37, 39, 41, 43, 45, 47, 49, 51, 53, 55, 57, 59, 61, 63, 65 respectively or fragments comprising at least 50, 75, 100, 200, 300, 500 or more consecutive amino acids of one of the polypeptides of SEQ ID NOS: 2, 4, 7, 9, 11, 13, 15, 18, 20, 22, 24, 26, 28, 30, 32 and 35, 37, 39, 41, 43, 45, 47, 49, 51, 53, 55, 57, 59, 61, 63, 65. Accordingly, another aspect of the present invention is an isolated, purified or enriched nucleic acid which encodes one of the polypeptides of SEQ ID NOS: 2, 4, 7, 9, 11, 13, 15, 18, 20, 22, 24, 26, 28, 30, 32 and 35, 37, 39, 41, 43, 45, 47, 49, 51, 53, 55, 57, 59, 61, 63, 65 or fragments comprising at least 50, 75, 100, 150, 200, 300 or more consecutive amino acids of one of the polypeptides of SEQ ID NOS: 2, 4, 7, 9, 11, 13, 15, 18, 20, 22, 24, 26, 28, 30, 32 and 35, 37, 39, 41, 43, 45, 47, 49, 51, 53, 55, 57, 59, 61, 63, 65. The coding sequences of these nucleic acids may be identical to one of the coding sequences of one of the nucleic acids of SEQ ID NOS: 3, 5, 8, 10, 12, 14, 16, 19, 21, 23, 25, 27, 29, 31, 33 and 36, 38, 40, 42, 44, 46, 48, 50, 52, 54, 56, 58, 60, 62, 64, 66 or a fragment thereof or may be different coding sequences which encode one of the polypeptides of SEQ ID NOS: 2, 4, 7, 9, 11, 13, 15, 18, 20, 22, 24, 26, 28, 30, 32 and 35, 37, 39, 41, 43, 45, 47, 49, 51, 53, 55, 57, 59, 61, 63, 65 or fragments comprising at least 50, 75, 100, 150, 200, 300 consecutive amino acids of one of the polypeptides of SEQ ID NOS: 2, 4, 7, 9, 11, 13, 15, 18, 20, 22, 24, 26, 28, 30, 32 and 35, 37, 39, 41, 43, 45, 47, 49, 51, 53, 55, 57, 59, 61, 63, 65 as a result of the redundancy or degeneracy of the genetic code. The genetic code is well known to those of skill in the art and can be obtained, for example, from Stryer, Biochemistry, $3^{rd}$ edition, W. H. Freeman & Co., New York.

The isolated, purified or enriched nucleic acid which encodes one of the polypeptides of SEQ ID NOS: 2, 4, 7, 9, 11, 13, 15, 18, 20, 22, 24, 26, 28, 30, 32 and 35, 37, 39, 41, 43, 45, 47, 49, 51, 53, 55, 57, 59, 61, 63, 65, may include, but is not limited to: (1) only the coding sequences of one of SEQ ID NOS: 3, 5, 8, 10, 12, 14, 16, 19, 21, 23, 25, 27, 29, 31, 33 and 36, 38, 40, 42, 44, 46, 48, 50, 52, 54, 56, 58, 60, 62, 64, 66; (2) the coding sequences of SEQ ID NOS: 3, 5, 8, 10, 12, 14, 16, 19, 21, 23, 25, 27, 29, 31, 33 and 36, 38, 40, 42, 44, 46, 48, 50, 52, 54, 56, 58, 60, 62, 64, 66 and additional coding sequences, such as leader sequences or proprotein; and (3) the coding sequences of SEQ ID NOS: 3, 5, 8, 10, 12, 14, 16, 19, 21, 23, 25, 27, 29, 31, 33 and nt0 and non-coding sequences, such as introns or non-coding sequences 5' and/or 3' of the coding sequence. Thus, as used herein, the term "polynucleotide encoding a polypeptide" encompasses a polynucleotide that includes only coding sequence for the polypeptide as well as a polynucleotide that includes additional coding and/or non-coding sequence.

The invention relates to polynucleotides based on SEQ ID NOS: 3, 5, 8, 10, 12, 14, 16, 19, 21, 23, 25, 27, 29, 31, 33 and 36, 38, 40, 42, 44, 46, 48, 50, 52, 54, 56, 58, 60, 62, 64, 66 but having polynucleotide changes that are "silent", for example changes which do not alter the amino acid sequence encoded by the polynucleotides of SEQ ID NOS: 3, 5, 8, 10, 12, 14, 16, 19, 21, 23, 25, 27, 29, 31, 33 and 36, 38, 40, 42, 44, 46, 48, 50, 52, 54, 56, 58, 60, 62, 64, 66. The invention also relates to polynucleotides which have nucleotide changes which result in amino acid substitutions, additions, deletions, fusions and truncations of the polypeptides of SEQ ID NOS: 2, 4, 7, 9, 11, 13, 15, 18, 20, 22, 24, 26, 28, 30, 32 and 35, 37, 39, 41, 43, 45, 47, 49, 51, 53, 55, 57, 59, 61, 63, 65. Such nucleotide changes may be introduced using techniques such as site directed mutagenesis, random chemical mutagenesis, exonuclease III deletion, and other recombinant DNA techniques.

The isolated, purified or enriched nucleic acids of SEQ ID NOS: 3, 5, 8, 10, 12, 14, 16, 19, 21, 23, 25, 27, 29, 31, 33 and 36, 38, 40, 42, 44, 46, 48, 50, 52, 54, 56, 58, 60, 62, 64, 66, the sequences complementary thereto, or a fragment comprising at least 10, 15, 20, 25, 30, 35, 40, 50, 75, 100, 150, 200, 300, 400 or 500 consecutive bases of one of the sequence of SEQ ID NOS: 3, 5, 8, 10, 12, 14, 16, 19, 21, 23, 25, 27, 29, 31, 33 and 36, 38, 40, 42, 44, 46, 48, 50, 52, 54, 56, 58, 60, 62, 64, 66, or the sequences complementary thereto may be used as probes to identify and isolate DNAs encoding the polypeptides of SEQ ID NOS: 2, 4, 7, 9, 11, 13, 15, 18, 20, 22, 24, 26, 28, 30, 32 and 35, 37, 39, 41, 43, 45, 47, 49, 51, 53, 55, 57, 59, 61, 63, 65 respectively. In such procedures, a genomic DNA library is constructed from a sample microorganism or a sample containing a microorganism capable of producing a lipopeptide. The genomic DNA library is then contacted with a probe comprising a coding sequence or a fragment of the coding sequence, encoding one of the polypeptides of SEQ ID NOS: 2, 4, 7, 9, 11, 13, 15, 18, 20, 22, 24, 26, 28, 30, 32 and 35, 37, 39, 41, 43, 45, 47, 49, 51, 53, 55, 57, 59, 61, 63, 65, or a fragment thereof under conditions which permit the probe to specifically hybridize to sequences complementary thereto. In a preferred embodiment, the probe is an oligonucleotide of about 10 to about 30 nucleotides in length designed based on a nucleic acid of SEQ ID NOS: 3, 5, 8, 10, 12, 14, 16, 19, 21, 23, 25, 27, 29, 31, 33 and 36, 38, 40, 42, 44, 46, 48, 50, 52, 54, 56, 58, 60, 62, 64, 66. Genomic DNA clones which hybridize to the probe are then detected and isolated. Procedures for preparing and identifying DNA clones of interest are disclosed in Ausubel et al., Current Protocols in Molecular Biology, John Wiley 503 Sons, Inc. 1997; and Sambrook et al., Molecular Cloning: A Laboratory Manual 2d Ed., Cold Spring Harbor Laboratory Press, 1989. In another embodiment, the probe is a restriction fragment or a PCR amplified nucleic acid derived from SEQ ID NOS: 3, 5, 8, 10, 12, 14, 16, 19, 21, 23, 25, 27, 29, 31, 33 and 36, 38, 40, 42, 44, 46, 48, 50, 52, 54, 56, 58, 60, 62, 64, 66.

The isolated, purified or enriched nucleic acids of SEQ ID NOS: 3, 5, 8, 10, 12, 14, 16, 19, 21, 23, 25, 27, 29, 31, 33 and 36, 38, 40, 42, 44, 46, 48, 50, 52, 54, 56, 58, 60, 62, 64, 66, the sequences complementary thereto, or a fragment comprising at least 10, 15, 20, 25, 30, 35, 40, 50, 75, 100, 150, 200, 300, 400 or 500 consecutive bases of one of the sequences of SEQ ID NOS: 3, 5, 8, 10, 12, 14, 16, 19, 21, 23, 25, 27, 29, 31, 33 and 36, 38, 40, 42, 44, 46, 48, 50, 52, 54, 56, 58, 60, 62, 64, 66, or the sequences complementary thereto may be used as probes to identify and isolate related nucleic acids. In some embodiments, the related nucleic acids may be genomic DNAs (or cDNAs) from potential lipopeptide producers. In such procedures, a nucleic acid sample containing nucleic acids from a potential lipopeptide-producer is contacted with the probe under conditions that permit the probe to specifically hybridize to related sequences. The nucleic acid sample may be a genomic DNA (or cDNA) library from the potential lipopeptide-producer. Hybridization of the probe to nucleic acids is then detected using any of the methods described above.

Hybridization may be carried out under conditions of low stringency, moderate stringency or high stringency. As an example of nucleic acid hybridization, a polymer membrane containing immobilized denatured nucleic acids is first prehybridized for 30 minutes at 45° C. in a solution consisting of 0.9 M NaCl, 50 mM NaH$_2$PO$_4$, pH 7.0, 5.0 mM Na$_2$EDTA, 0.5% SDS, 10× Denhardt's, and 0.5 mg/ml polyriboadenylic acid. Approximately 2×10$^7$ cpm (specific activity 4–9×10$^8$ cpm/ug) of $^{32}$P end-labeled oligonucleotide probe are then added to the solution. After 12–16 hours of incubation, the membrane is washed for 30 minutes at room temperature in 1×SET (150 mM NaCl, 20 mM Tris hydrochloride, pH 7.8, 1 mM Na$_2$EDTA) containing 0.5% SDS, followed by a 30 minute wash in fresh 1×SET at Tm-10° C. for the oligonucleotide probe where Tm is the melting temperature. The membrane is then exposed to autoradiographic film for detection of hybridization signals.

By varying the stringency of the hybridization conditions used to identify nucleic acids, such as genomic DNAs or cDNAs, which hybridize to the detectable probe, nucleic acids having different levels of homology to the probe can be identified and isolated. Stringency may be varied by conducting the hybridization at varying temperatures below the melting temperatures of the probes. The melting temperature of the probe may be calculated using the following formulas:

For oligonucleotide probes between 14 and 70 nucleotides in length the melting temperature (Tm) in degrees Celcius may be calculated using the formula:

$$Tm=81.5+16.6(\log [Na+])+0.41(\text{fraction } G+C)-(600/N)$$ where N is the length of the oligonucleotide.

If the hybridization is carried out in a solution containing formamide, the melting temperature may be calculated using the equation Tm=81.5+16.6(log [Na+])+0.41 (fraction G+C)–(0.63% formamide)–(600/N) where N is the length of the probe.

Prehybridization may be carried out in 6×SSC, 5×Denhardt's reagent, 0.5% SDS, 0.1 mg/ml denatured fragmented salmon sperm DNA or 6×SSC, 5×Denhardt's reagent, 0.5% SDS, 0.1 mg/ml denatured fragmented salmon sperm DNA, 50% formamide. The composition of the SSC and Denhardt's solutions are listed in Sambrook et al., supra.

Hybridization is conducted by adding the detectable probe to the hybridization solutions listed above. Where the probe comprises double stranded DNA, it is denatured by incubating at elevated temperatures and quickly cooling before addition to the hybridization solution. It may also be desirable to similarly denature single stranded probes to eliminate or diminish formation of secondary structures or oligomerization. The filter is contacted with the hybridization solution for a sufficient period of time to allow the probe to hybridize to cDNAs or genomic DNAs containing sequences complementary thereto or homologous thereto. For probes over 200 nucleotides in length, the hybridization may be carried out at 15–25° C. below the Tm. For shorter probes, such as oligonucleotide probes, the hybridization may be conducted at 5–10° C. below the Tm. Preferably, the hybridization is conducted in 6×SSC, for shorter probes. Preferably, the hybridization is conducted in 50% formamide containing solutions, for longer probes.

All the foregoing hybridizations would be considered to be examples of hybridization performed under conditions of high stringency.

Following hybridization, the filter is washed for at least 15 minutes in 2×SSC, 0.1% SDS at room temperature or higher, depending on the desired stringency. The filter is then washed with 0.1×SSC, 0.5% SDS at room temperature (again) for 30 minutes to 1 hour.

Nucleic acids which have hybridized to the probe are identified by conventional autoradiography and non-radioactive detection methods.

The above procedure may be modified to identify nucleic acids having decreasing levels of homology to the probe sequence. For example, to obtain nucleic acids of decreasing homology to the detectable probe, less stringent conditions may be used. For example, the hybridization temperature may be decreased in increments of 5° C. from 68° C. to 42° C. in a hybridization buffer having a Na+ concentration of approximately 1M. Following hybridization, the filter may be washed with 2×SSC, 0.5% SDS at the temperature of hybridization. These conditions are considered to be "moderate stringency" conditions above 50° C. and "low stringency" conditions below 50° C. A specific example of "moderate stringency" hybridization conditions is when the above hybridization is conducted at 55° C. A specific example of "low stringency" hybridization conditions is when the above hybridization is conducted at 45° C.

Alternatively, the hybridization may be carried out in buffers, such as 6×SSC, containing formamide at a temperature of 42° C. In this case, the concentration of formamide in the hybridization buffer may be reduced in 5% increments from 50% to 0% to identify clones having decreasing levels of homology to the probe. Following hybridization, the filter may be washed with 6×SSC, 0.5% SDS at 50° C. These conditions are considered to be "moderate stringency" conditions above 25% formamide and "low stringency" conditions below 25% formamide. A specific example of "moderate stringency" hybridization conditions is when the above hybridization is conducted at 30% formamide. A specific example of "low stringency" hybridization conditions is when the above hybridization is conducted at 10% formamide.

Nucleic acids which have hybridized to the probe are identified by conventional autoradiography and non-radioactive detection methods.

For example, the preceding methods may be used to isolate nucleic acids having a sequence with at least 97%, at least 95%, at least 90%, at least 85%, at least 80%, or at least 70% homology to a nucleic acid sequence selected from the group consisting of the sequences of SEQ ID NOS: 3, 5, 8, 10, 12, 14, 16, 19, 21, 23, 25, 27, 29, 31, 33 and 36, 38, 40, 42, 44, 46, 48, 50, 52, 54, 56, 58, 60, 62, 64, 66, fragments comprising at least 10, 15, 20, 25, 30, 35, 40, 50, 75, 100, 150, 200, 300, 400, or 500 consecutive bases thereof, and the sequences complementary thereto. Homology may be measured using BLASTN version 2.0 with the default parameters. For example, the homologous polynucleotides may have a coding sequence that is a naturally occurring allelic variant of one of the coding sequences described herein. Such allelic variant may have a substitution, deletion or addition of one or more nucleotides when compared to the nucleic acids of SEQ ID NOS: 3, 5, 8, 10, 12, 14, 16, 19, 21, 23, 25, 27, 29, 31, 33 and 36, 38, 40, 42, 44, 46, 48, 50, 52, 54, 56, 58, 60, 62, 64, 66, or the sequences complementary thereto.

Additionally, the above procedures may be used to isolate nucleic acids which encode polypeptides having at least 99%, 95%, at least 90%, at least 85%, at least 80%, or at least 70% homology to a polypeptide having the sequence of one of SEQ ID NOS: 2, 4, 7, 9, 11, 13, 15, 18, 20, 22, 24, 26, 28, 30, 32 and 35, 37, 39, 41, 43, 45, 47, 49, 51, 53, 55, 57, 59, 61, 63, 65, or fragments comprising at least 50, 75, 100, 150, 200, 300 consecutive amino acids thereof as determined using the BLASTP version 2.2.2 algorithm with default parameters.

Another aspect of the present invention is an isolated or purified polypeptide comprising the sequence of one of SEQ ID NOS: 2, 4, 7, 9, 11, 13, 15, 18, 20, 22, 24, 26, 28, 30, 32 and 35, 37, 39, 41, 43, 45, 47, 49, 51, 53, 55, 57, 59, 61, 63, 65 or fragments comprising at least 50, 75, 100, 150, 200 or 300 consecutive amino acids thereof. As discussed herein, such polypeptides may be obtained by inserting a nucleic acid encoding the polypeptide into a vector such that the coding sequence is operably linked to a sequence capable of driving the expression of the encoded polypeptide in a suitable host cell. For example, the expression vector may comprise a promoter, a ribosome binding site for translation initiation and a transcription terminator. The vector may also include appropriate sequences for modulating expression levels, an origin of replication and a selectable marker.

Promoters suitable for expressing the polypeptide or fragment thereof in bacteria include the *E. coli* lac or trp promoters, the lacI promoter, the lacZ promoter, the T3 promoter, the T7 promoter, the gpt promoter, the lambda $P_R$ promoter, the lambda $P_L$ promoter, promoters from operons encoding glycolytic enzymes such as 3-phosphoglycerate kinase (PGK), and the acid phosphatase promoter. Fungal promoters include the α factor promoter. Eukaryotic promoters include the CMV immediate early promoter, the HSV thymidine kinase promoter, heat shock promoters, the early and late SV40 promoter, LTRs from retroviruses, and the mouse metallothionein-I promoter. Other promoters known to control expression of genes in prokaryotic or eukaryotic cells or their viruses may also be used.

Mammalian expression vectors may also comprise an origin of replication, any necessary ribosome binding sites, a polyadenylation site, splice donors and acceptor sites, transcriptional termination sequences, and 5' flanking non-transcribed sequences. In some embodiments, DNA sequences derived from the SV40 splice and polyadenylation sites may be used to provide the required nontranscribed genetic elements.

Vectors for expressing the polypeptide or fragment thereof in eukaryotic cells may also contain enhancers to increase expression levels. Enhancers are cis-acting elements of DNA, usually from about 10 to about 300 bp in length that act on a promoter to increase its transcription. Examples include the SV40 enhancer on the late side of the replication origin bp 100 to 270, the cytomegalovirus early promoter enhancer, the polyoma enhancer on the late side of the replication origin, and the adenovirus enhancers.

In addition, the expression vectors preferably contain one or more selectable marker genes to permit selection of host cells containing the vector. Examples of selectable markers that may be used include genes encoding dihydrofolate reductase or genes conferring neomycin resistance for eukaryotic cell culture, genes conferring tetracycline or ampicillin resistance in *E. coli*, and the *S. cerevisiae* TRP1 gene.

In some embodiments, the nucleic acid encoding one of the polypeptides of SEQ ID NOS: 2, 4, 7, 9, 11, 13, 15, 18, 20, 22, 24, 26, 28, 30, 32 and 35, 37, 39, 41, 43, 45, 47, 49, 51, 53, 55, 57, 59, 61, 63, 65, or fragments comprising at least 50, 75, 100, 150, 200 or 300 consecutive amino acids thereof is assembled in appropriate phase with a leader sequence capable of directing secretion of the translated polypeptides or fragments thereof. Optionally, the nucleic acid can encode a fusion polypeptide in which one of the polypeptide of SEQ ID NOS: 2, 4, 7, 9, 11, 13, 15, 18, 20, 22, 24, 26, 28, 30, 32 and 35, 37, 39, 41, 43, 45, 47, 49, 51, 53, 55, 57, 59, 61, 63, 65 or fragments comprising at least 5, 10, 15, 20, 25, 30, 35, 40, 50, 75, 100, or 150 consecutive amino acids thereof is fused to heterologous peptides or polypeptides, such as N-terminal identification peptides which impart desired characteristics such as increased stability or simplified purification or detection.

The appropriate DNA sequence may be inserted into the vector by a variety of procedures. In general, the DNA sequence is ligated to the desired position in the vector following digestion of the insert and the vector with appropriate restriction endonucleases. Alternatively, appropriate restriction enzyme sites can be engineered into a DNA sequence by PCR. A variety of cloning techniques are disclosed in Ausbel et al. Current Protocols in Molecular Biology, John Wiley 503 Sons, Inc. 1997 and Sambrook et al., Molecular Cloning: A Laboratory Manual 2d Ed., Cold Spring Harbor Laboratory Press, 1989. Such procedures and others are deemed to be within the scope of those skilled in the art.

The vector may be, for example, in the form of a plasmid, a viral particle, or a phage. Other vectors include derivatives of chromosomal, nonchromosomal and synthetic DNA sequences, viruses, bacterial plasmids, phage DNA, baculovirus, yeast plasmids, vectors derived from combinations of plasmids and phage DNA, viral DNA such as vaccinia, adenovirus, fowl pox virus, and pseudorabies. A variety of cloning and expression vectors for use with prokaryotic and eukaryotic hosts are described by Sambrook, et al., Molecular Cloning: A Laboratory Manual, Second Edition, Cold Spring Harbor, N.Y., (1989).

Particular bacterial vectors which may be used include the commercially available plasmids comprising genetic elements of the well known cloning vector pBR322 (ATCC 37017), pKK223-3 (Pharmacia Fine Chemicals, Uppsala, Sweden), pGEM1 (Promega Biotec, Madison, Wis., USA) pQE70, pQE60, pQE-9 (Qiagen), pD10, phiX174, pBluescript II KS, pNH8A, pNH16a, pNH18A, pNH46A (Stratagene), ptrc99a, pKK223-3, pKK233-3, pDR540, pRIT5 (Pharmacia), pKK232-8 and pCM7. Particular eukaryotic vectors include pSV2CAT, pOG44, pXT1, pSG (Stratagene) pSVK3, pBPV, pMSG, and pSVL (Pharmacia). However, any other vector may be used as long as it is replicable and stable in the host cell.

The host cell may be any of the host cells familiar to those skilled in the art, including prokaryotic cells or eukaryotic cells. As representative examples of appropriate hosts, there may be mentioned: bacteria cells, such as *E. coli, Streptomyces, Bacillus subtilis, Salmonella typhimurium* and various species within the genera *Pseudomonas, Streptomyces*, and *Staphylococcus*, fungal cells, such as yeast, insect cells such as *Drosophila* S2 and *Spodoptera* Sf9, animal cells such as CHO, COS or Bowes melanoma, and adenoviruses. The selection of an appropriate host is within the abilities of those skilled in the art.

The vector may be introduced into the host cells using any of a variety of techniques, including electroporation transformation, transfection, transduction, viral infection, gene guns, or Ti-mediated gene transfer. Where appropriate, the engineered host cells can be cultured in conventional nutrient media modified as appropriate for activating promoters, selecting transformants or amplifying the genes of the present invention. Following transformation of a suitable host strain and growth of the host strain to an appropriate cell density, the selected promoter may be induced by appropriate means (e.g., temperature shift or chemical induction) and the cells may be cultured for an additional period to allow them to produce the desired polypeptide or fragment thereof.

Cells are typically harvested by centrifugation, disrupted by physical or chemical means, and the resulting crude extract is retained for further purification. Microbial cells employed for expression of proteins can be disrupted by any convenient method, including freeze-thaw cycling, sonication, mechanical disruption, or use of cell lysing agents. Such methods are well known to those skilled in the art. The expressed polypeptide or fragment thereof can be recovered and purified from recombinant cell cultures by methods including ammonium sulfate or ethanol precipitation, acid extraction, anion or cation exchange chromatography, phosphocellulose chromatography, hydrophobic interaction chromatography, affinity chromatography, hydroxylapatite chromatography and lectin chromatography. Protein refolding steps can be used, as necessary, in completing configuration of the polypeptide. If desired, high performance liquid chromatography (HPLC) can be employed for final purification steps.

Various mammalian cell culture systems can also be employed to express recombinant protein. Examples of mammalian expression systems include the COS-7 lines of monkey kidney fibroblasts (described by Gluzman, Cell, 23:175 (1981)), and other cell lines capable of expressing proteins from a compatible vector, such as the C127, 3T3, CHO, HeLa and BHK cell lines.

The constructs in host cells can be used in a conventional manner to produce the gene product encoded by the recombinant sequence. Depending upon the host employed in a recombinant production procedure, the polypeptide produced by host cells containing the vector may be glycosylated or may be non-glycosylated. Polypeptides of the invention may or may not also include an initial methionine amino acid residue.

Alternatively, the polypeptides of SEQ ID NOS: 2, 4, 7, 9, 11, 13, 15, 18, 20, 22, 24, 26, 28, 30, 32 and 35, 37, 39, 41, 43, 45, 47, 49, 51, 53, 55, 57, 59, 61, 63, 65, or fragments comprising at least 50, 75, 100, 150, 200 or 300 consecutive amino acids thereof can be synthetically produced by conventional peptide synthesizers. In other embodiments, fragments or portions of the polynucleotides may be employed for producing the corresponding full-length polypeptide by peptide synthesis; therefore, the fragments may be employed as intermediates for producing the full-length polypeptides.

Cell-free translation systems can also be employed to produce one of the polypeptides of SEQ ID NOS: 2, 4, 7, 9, 11, 13, 15, 18, 20, 22, 24, 26, 28, 30, 32 and 35, 37, 39, 41, 43, 45, 47, 49, 51, 53, 55, 57, 59, 61, 63, 65, or fragments comprising at least 50, 75, 100, 150, 200 or 300 consecutive amino acids thereof using mRNAs transcribed from a DNA construct comprising a promoter operably linked to a nucleic acid encoding the polypeptide or fragment thereof. In some embodiments, the DNA construct may be linearized prior to conducting an in vitro transcription reaction. The transcribed mRNA is then incubated with an appropriate cell-free translation extract, such as a rabbit reticulocyte extract, to produce the desired polypeptide or fragment thereof.

The present invention also relates to variants of the polypeptides of SEQ ID NOS: 2, 4, 7, 9, 11, 13, 15, 18, 20, 22, 24, 26, 28, 30, 32 and 35, 37, 39, 41, 43, 45, 47, 49, 51, 53, 55, 57, 59, 61, 63, 65, or fragments comprising at least 50, 75, 100, 150, 200 or 300 consecutive amino acids thereof. The term "variant" includes derivatives or analogs of these polypeptides. In particular, the variants may differ in amino acid sequence from the polypeptides of SEQ ID NOS: 2, 4, 7, 9, 11, 13, 15, 18, 20, 22, 24, 26, 28, 30, 32 and 35, 37, 39, 41, 43, 45, 47, 49, 51, 53, 55, 57, 59, 61, 63, 65, by one or more substitutions, additions, deletions, fusions and truncations, which may be present in any combination.

The variants may be naturally occurring or created in vitro. In particular, such variants may be created using genetic engineering techniques such as site directed mutagenesis, random chemical mutagenesis, Exonuclease III deletion procedures, and standard cloning techniques. Alternatively, such variants, fragments, analogs, or derivatives may be created using chemical synthesis or modification procedures.

Other methods of making variants are also familiar to those skilled in the art. These include procedures in which nucleic acid sequences obtained from natural isolates are modified to generate nucleic acids that encode polypeptides having characteristics which enhance their value in industrial or laboratory applications. In such procedures, a large number of variant sequences having one or more nucleotide differences with respect to the sequence obtained from the natural isolate are generated and characterized. Preferably, these nucleotide differences result in amino acid changes with respect to the polypeptides encoded by the nucleic acids from the natural isolates.

For example, variants may be created using error prone PCR. In error prone PCR, DNA amplification is performed under conditions where the fidelity of the DNA polymerase is low, such that a high rate of point mutation is obtained along the entire length of the PCR product. Error prone PCR is described in Leung, D. W., et al., Technique, 1:11–15 (1989) and Caldwell, R. C. & Joyce G. F., PCR Methods Applic., 2:28–33 (1992). Variants may also be created using site directed mutagenesis to generate site-specific mutations in any cloned DNA segment of interest. Oligonucleotide mutagenesis is described in Reidhaar-Olson, J. F. & Sauer, R. T., et al., Science, 241:53–57 (1988). Variants may also be created using directed evolution strategies such as those described in U.S. Pat. Nos. 6,361,974 and 6,372,497. The variants of the polypeptides of SEQ ID NOS: 2, 4, 7, 9, 11, 13, 15, 18, 20, 22, 24, 26, 28, 30, 32 and 35, 37, 39, 41, 43, 45, 47, 49, 51, 53, 55, 57, 59, 61, 63, 65, may be (i) variants in which one or more of the amino acid residues of the polypeptides of SEQ ID NOS: 3, 5, 8, 10, 12, 14, 16, 19, 21, 23, 25, 27, 29, 31, 33 and 36, 38, 40, 42, 44, 46, 48, 50, 52, 54, 56, 58, 60, 62, 64, 66, are substituted with a conserved or non-conserved amino acid residue (preferably a conserved amino acid residue) and such substituted amino acid residue may or may not be one encoded by the genetic code.

Conservative substitutions are those that substitute a given amino acid in a polypeptide by another amino acid of like characteristics. Typically seen as conservative substitutions are the following replacements: replacements of an aliphatic amino acid such as Ala, Val, Leu and Ile with another aliphatic amino acid; replacement of a Ser with a Thr or vice versa; replacement of an acidic residue such as Asp or Glu with another acidic residue; replacement of a residue bearing an amide group, such as Asn or Gln, with another residue bearing an amide group; exchange of a basic residue such as Lys or Arg with another basic residue; and replacement of an aromatic residue such as Phe or Tyr with another aromatic residue. Other variants are those in which one or more of the amino acid residues of the polypeptides of SEQ ID NOS: 2, 4, 7, 9, 11, 13, 15, 18, 20, 22, 24, 26, 28, 30, 32 and 35, 37, 39, 41, 43, 45, 47, 49, 51, 53, 55, 57, 59, 61, 63, 65 includes a substituent group.

Still other variants are those in which the polypeptide is associated with another compound, such as a compound to increase the half-life of the polypeptide (for example, polyethylene glycol).

Additional variants are those in which additional amino acids are fused to the polypeptide, such as leader sequence, a secretory sequence, a proprotein sequence or a sequence which facilitates purification, enrichment, or stabilization of the polypeptide. In some embodiments, the fragments, derivatives and analogs retain the same biological function or activity as the polypeptides of SEQ ID NOS: 2, 4, 7, 9, 11, 13, 15, 18, 20, 22, 24, 26, 28, 30, 32 and 35, 37, 39, 41, 43, 45, 47, 49, 51, 53, 55, 57, 59, 61, 63, 65. In other embodiments, the fragment, derivative or analogue includes a fused heterologous sequence which facilitates purification, enrichment, detection, stabilization or secretion of the polypeptide that can be enzymatically cleaved, in whole or in part, away from the fragment, derivative or analogue.

Another aspect of the present invention are polypeptides or fragments thereof which have at least 70%, at least 80%, at least 85%, at least 90%, or more than 95% homology to one of the polypeptides of SEQ ID NOS: 2, 4, 7, 9, 11, 13, 15, 18, 20, 22, 24, 26, 28, 30, 32 and 35, 37, 39, 41, 43, 45, 47, 49, 51, 53, 55, 57, 59, 61, 63, 65, or a fragment comprising at least 50, 75, 100, 150, 200 or 300 consecutive amino acids thereof. Homology may be determined using a program, such as BLASTP version 2 with the default parameters, or other like programs which align the polypeptides or fragments being compared and determines the extent of amino acid identity or similarity between them. It will be appreciated that amino acid "homology" includes conservative substitutions such as those described above.

The polypeptides or fragments having homology to one of the polypeptides of SEQ ID NOS: 2, 4, 7, 9, 11, 13, 15, 18, 20, 22, 24, 26, 28, 30, 32 and 35, 37, 39, 41, 43, 45, 47, 49, 51, 53, 55, 57, 59, 61, 63, 65, or a fragment comprising at least 50, 75, 100, 150, 200 or 300 consecutive amino acids thereof may be obtained by isolating the nucleic acids encoding them using the techniques described above.

Alternatively, the homologous polypeptides or fragments may be obtained through biochemical enrichment or purification procedures. The sequence of potentially homologous polypeptides or fragments may be determined by proteolytic digestion, gel electrophoresis and/or microsequencing. The sequence of the prospective homologous polypeptide or fragment can be compared to one of the polypeptides of SEQ ID NOS: 2, 4, 7, 9, 11, 13, 15, 18, 20, 22, 24, 26, 28, 30, 32 and 35, 37, 39, 41, 43, 45, 47, 49, 51, 53, 55, 57, 59, 61, 63, 65, or a fragment comprising at least 5, 10, 15, 20, 25, 30, 35, 40, 50, 75, 100, or 150 consecutive amino acids thereof using a program such as BLASTP version 2 with the default parameters.

The polypeptides of SEQ ID NOS: 2, 4, 7, 9, 11, 13, 15, 18, 20, 22, 24, 26, 28, 30, 32 and 35, 37, 39, 41, 43, 45, 47, 49, 51, 53, 55, 57, 59, 61, 63, 65, or fragments, derivatives or analogs thereof comprising at least 40, 50, 75, 100, 150, 200 or 300 consecutive amino acids thereof invention may be used in a variety of applications. For example, the polypeptides or fragments, derivatives or analogs thereof may be used to catalyze certain biochemical reactions. In particular, the polypeptide of the OXAU family, namely SEQ ID NO: 35 or fragments, derivatives or analogs thereof may be used, in vitro or in vivo, to catalyze oxidation reactions to modify acyl fatty acid precursors that are either endogenously produced by the host, supplemented to the growth medium, or are added to a cell-free, purified or enriched preparation of said polypeptide; the ADLF and ADLE families, namely SEQ ID NOS: 2 and 37 or fragments, derivatives or analogs thereof may be used, in vitro or in vivo, to catalyze activation and tethering to acyl carrier proteins, or to themselves (ADLF; SEQ ID NO: 2) of acyl fatty acids that are either endogenously produced by the host, supplemented to the growth medium, or are added to a cell-free, purified or enriched preparation of said polypeptide; the ACPH family, namely SEQ ID NO: 39 or fragments, derivatives or analogs thereof may be used, in vitro or in vivo, to be loaded with activated acyl fatty acids that are either endogenously produced by the host, supplemented to the growth medium, or are added to a cell-free, purified or enriched preparation of said polypeptide. Polypeptides of the PPST family, namely SEQ ID NOS: 4, 7, 9, 11, 13, 41, 43, 45 and 47, or fragments, derivatives or analogs thereof may be used in any combination, in vitro or in vivo, to direct the synthesis of peptides of determined amino acid composition either in their natural context or in hybrid polypeptide synthetase systems originating from different nonribosomal peptide biosynthetic loci. Families OXAB, namely SEQ ID NOS: 20 and 53, and OXDD, namely SEQ ID NOS: 24 and 57, or fragments, derivatives or analogs thereof may be used in any combination, in vitro or in vivo, to catalyze oxidation reactions that modify compounds that are either endogenously produced by the host, supplemented to the growth medium, or are added to a cell-free, purified or enriched preparation of said polypeptide. Families MTAG, namely SEQ ID NOS: 22 and 55, and MTFZ, namely SEQ ID NOS: 32 and 65, or fragments, derivatives or analogs thereof may be used in any combination, in vitro or in vivo, to catalyze transfer of methyl groups modifying compounds that are either endogenously produced by the host, supplemented to the growth medium, or are added to a cell-free, purified or enriched preparation of said polypeptide. Polypeptides of the families ABCD, namely SEQ ID NOS: 26 and 59, MEMD, namely SEQ ID NOS: 28 and 61 and MEMT, namely SEQ ID NOS: 30 and 63, or fragments, derivatives or analogs thereof may be used in any combination, to confer to microorganisms or eukaryotic cells resistance to lipopeptides or to increase the yield of lipopeptides in either naturally producing organisms or heterologously producing recombinant organisms.

The polypeptides of SEQ ID NOS: 2, 4, 7, 9, 11, 13, 15, 18, 20, 22, 24, 26, 28, 30, 32 and 35, 37, 39, 41, 43, 45, 47, 49, 51, 53, 55, 57, 59, 61, 63, 65, or fragments, derivatives or analogues thereof comprising at least 5, 10, 15, 20, 25, 30, 35, 40, 50, 75, 100, or 150 consecutive amino acids thereof, may also be used to generate antibodies which bind specifically to the polypeptides or fragments, derivatives or analogues. The antibodies generated from SEQ ID NOS: 2, 4, 7, 9, 11, 13, 15, 18, 20, 22, 24, 26, 28, 30, 32 may be used to determine whether a biological sample contains *Streptomyces fradiae* or a related microorganism. The antibodies generated from SEQ ID NOS: 35, 37, 39, 41, 43, 45, 47, 49, 51, 53, 55, 57, 59, 61, 63, 65 may be used to determine whether a biological sample contains *Streptomyces refuineus* or a related microorganism.

In such procedures, a biological sample is contacted with an antibody capable of specifically binding to one of the polypeptides of SEQ ID NOS: 2, 4, 7, 9, 11, 13, 15, 18, 20, 22, 24, 26, 28, 30, 32 and 35, 37, 39, 41, 43, 45, 47, 49, 51, 53, 55, 57, 59, 61, 63, 65, or fragments comprising at least 5, 10, 15, 20, 25, 30, 35, 40, 50, 75, 100, or 150 consecutive amino acids thereof. The ability of the biological sample to bind to the antibody is then determined. For example, binding may be determined by labeling the antibody with a detectable label such as a fluorescent agent, an enzymatic label, or a radioisotope. Alternatively, binding of the antibody to the sample may be detected using a secondary antibody having such a detectable label thereon. A variety of assay protocols which may be used to detect the presence of a lipopeptide-producer, a *Streptomyces fradiae* organism, a *Streptomyces refuineus* organism or polypeptides related to SEQ ID NOS: 2, 4, 7, 9, 11, 13, 15, 18, 20, 22, 24, 26, 28, 30, 32 and 35, 37, 39, 41, 43, 45, 47, 49, 51, 53, 55, 57, 59, 61, 63, 65, in a sample are familiar to those skilled in the art. Particular assays include ELISA assays, sandwich assays, radioimmunoassays, and Western Blots. Alternatively, antibodies generated from SEQ ID NOS: 2, 4, 7, 9, 11, 13, 15, 18, 20, 22, 24, 26, 28, 30, 32 and 35, 37, 39, 41, 43, 45, 47, 49, 51, 53, 55, 57, 59, 61, 63, 65 may be used to determine whether a biological sample contains related polypeptides that may be involved in the biosynthesis of A54145-type natural products or other lipopeptides.

Polyclonal antibodies generated against the polypeptides of SEQ ID NOS: 2, 4, 7, 9, 11, 13, 15, 18, 20, 22, 24, 26, 28, 30, 32 and 35, 37, 39, 41, 43, 45, 47, 49, 51, 53, 55, 57, 59, 61, 63, 65, or fragments comprising at least 5, 10, 15, 20, 25, 30, 35, 40, 50, 75, 100, or 150 consecutive amino acids thereof can be obtained by direct injection of the polypeptides into an animal or by administering the polypeptides to an animal, preferably a nonhuman. The antibody so obtained will then bind the polypeptide itself. In this manner, even a sequence encoding only a fragment of the polypeptide can be used to generate antibodies that may bind to the whole native polypeptide. Such antibodies can then be used to isolate the polypeptide from cells expressing that polypeptide.

For preparation of monoclonal antibodies, any technique which provides antibodies produced by continuous cell line cultures can be used. Examples include the hybridoma technique (Kholer and Milstein, 1975, Nature, 256:495–497), the trioma technique, the human B-cell hybridoma technique (Kozbor et al., 1983, Immunology Today 4:72), and the EBV-hybridoma technique (Cole, et al., 1985, in Monoclonal Antibodies and Cancer Therapy, Alan R. Liss, Inc., pp. 77–96). Techniques described for the production of single chain antibodies (U.S. Pat. No. 4,946,778) can be adapted to produce single chain antibodies to the polypeptides of SEQ ID NOS: 2, 4, 7, 9, 11, 13, 15, 18, 20, 22, 24, 26, 28, 30, 32 and 35, 37, 39, 41, 43, 45, 47, 49, 51, 53, 55, 57, 59, 61, 63, 65, or fragments comprising at least 5, 10, 15, 20, 25, 30, 35, 40, 50, 75, 100, or 150 consecutive amino acids thereof. Alternatively, transgenic mice may be used to express humanized antibodies to these polypeptides or fragments thereof. Antibodies generated against the polypeptides of SEQ ID NOS: 2, 4, 7, 9, 11, 13, 15, 18, 20, 22, 24, 26, 28, 30, 32 and 35, 37, 39, 41, 43, 45, 47, 49, 51, 53, 55, 57, 59, 61, 63, 65, or fragments comprising at least 5, 10, 15, 20, 25, 30, 35, 40, 50, 75, 100, or 150 consecutive amino acids thereof may be used in screening for similar polypeptides from a sample containing organisms or cell-free extracts thereof. In such techniques, polypeptides from the sample is contacted with the antibodies and those polypeptides which specifically bind the antibody are detected. Any of the procedures described above may be used to detect antibody binding. One such screening assay is described in "Methods for measuring Cellulase Activities", Methods in Enzymology, Vol 160, pp. 87–116.

The present invention will be further described with reference to the following examples; however, it is to be understood that the present invention is not limited to such examples.

EXAMPLE 1

Identification and Sequencing of A541

Figure 13A:
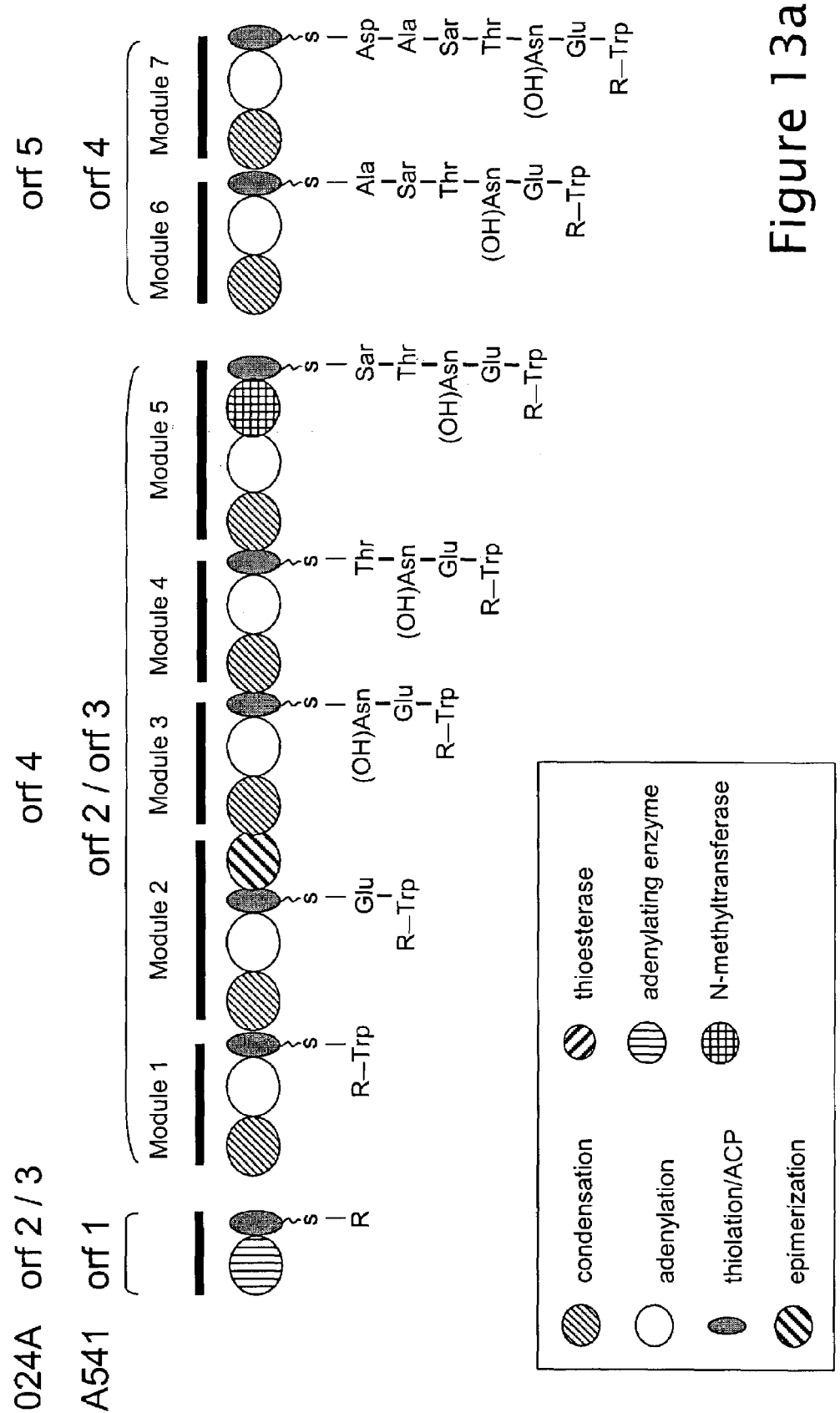
FIGS. 13a and 13b show corresponding NRPS proteins found in 024A and A541, the modules and domains forming each NRPS, and the biosynthetic pathway by which the respective 024A and A541 NRPS complexes assemble their products.

*Streptomyces fradiae* strain NRRL 18158 was known to express the lipopeptide antibiotic complex A-54145. The structure of lipopeptide antibiotic complex A-54145 is known as shown in FIG. 1. The peptide backbone of the chemical structure of A54145 clearly implicates the presence of NRPS enzymes in the biosynthesis of this compound. A DNA library was constructed using *Streptomyces fradiae* strain NRRL 18158 genomic DNA. Cosmids were selected by hybridization with NRPS specific oligonucleotide probes. The selected cosmids were screened by DNA sequencing and analyzed for the presence of NRPS encoding genes. Three overlapping cosmid clones shown to have a substantial NRPS gene content were selected for further studies. DNA sequence analysis of these cosmids revealed the presence of one partial NRPS gene, namely A541 ORFs 2 and 3 (SEQ ID NO: 4 and 7), and three complete NRPSs genes, namely A541 ORFs 4, 5 and 6 (SEQ ID NOS: 9, 11 and 13). Analysis of these ORFs demonstrated the presence of conserved typical NRPS domains involved in the recognition, activation, modification and condensation of amino acids. A total of 13 modules responsible for the condensation of 13 amino acid residues were identified. A54145 is composed of 13 amino acids providing an indication that the cloned locus might be the one responsible for A54145 biosynthesis. The adenylation domains were further examined for the specificity of the amino acids that they activate and tether to the PCP domain of the NRPS. The predicted specificities clearly corresponded to the nature and order of the amino acid residues found in the A54145 chemical structure providing conclusive evidence for the role of the cloned locus in the biosynthesis of the A54145 components (FIGS. 1 and 13). Further evidence was provided by the presence of a methylation domain found in ORF 3, module 5 specifying the amino acid glycine. Chemical characterization of A54145 showed that the amino acid incorporated in the fifth position is a N-methylated glycine (sarcosine) (FIGS. 1 and 13).

The nature and order of the amino acids specified by the NRPS genes as well as the presence of domains involved in the modification of some of the amino acids clearly demonstrate that the *Streptomyces fradiae* locus cloned and analyzed is involved in the expression of the lipopeptide complex A54145.

EXAMPLE 2

Genes and Proteins of A541

A541 is formed of three DNA contiguous sequences (SEQ ID NOS: 1, 6 and 17) arranged such that, as found within the A54145 biosynthetic locus, DNA contig 1 (SEQ ID NO: 1) is adjacent to the 5' end of DNA contig 2 (SEQ ID NO: 6) which in turn is adjacent to DNA contig 3 (SEQ ID NO: 17). More than 19 kilobases of DNA sequence were analyzed on each side of the A54145 locus and these regions contain primary metabolic genes. The order and relative position of the 15 ORFs representing the proteins of A541 are provided in FIG. 1. Contiguous nucleotide sequences and deduced amino acid sequences of A541 provided in the accompanying sequence listing.

Contig 1 is formed of the 13315 base pairs provided in SEQ ID NO: 1 and contains ORFs 1 and 2 of A541. The gene product of A541 ORF 1 (SEQ ID NO: 2) is the 723 amino acids deduced from the nucleic acid sequence of SEQ ID NO: 3 which is drawn from residues 1 to 2172 (sense strand) of contig 1 (SEQ ID NO: 1). The gene produce of A541 ORF 2 (SEQ ID NO: 4) is the 3700 amino acids representing the N-terminus of the polypeptide deduced from the nucleic acid sequence of SEQ ID NO: 5 which is drawn from residues 2216 to 13315 (sense strand) of contig 1 (SEQ ID NO: 1). Contig 2 is formed of the 37360 base pairs provided in SEQ ID NO: 6 and contains ORFs 3–7 of A541. The gene product of A541 ORF 3 (SEQ ID NO: 7) is the 2595 amino acids representing the C-terminus of the polypeptide deduced from the nucleic acid sequence of SEQ ID NO: 8 which is drawn from residues 2 to 7789 (sense strand) of contig 2 (SEQ ID NO: 6). The gene product of A541 ORF 4 (SEQ ID NO: 9) is the 2143 amino acids deduced from the nucleic acid sequence of SEQ ID NO: 10 which is drawn from residues 7786 to 14217 (sense strand) of contig 2 (SEQ ID NO: 6). The gene product of A541 ORF 5 (SEQ ID NO: 11) is the 5245 amino acids deduced from the nucleic acid sequence of SEQ ID NO: 12 which is drawn from residues 14217 to 29954 (sense strand) of contig 2 (SEQ ID NO: 6). The gene product of A541 ORF 6 (SEQ ID NO: 13) is the 2384 amino acids deduced from the nucleic acid sequence of SEQ ID NO: 14 which is drawn from residues 29954 to 37108 (sense strand) of contig 2 (SEQ ID NO: 6). The gene product of A541 ORF 7 (SEQ ID NO: 15) is the 78 amino acids deduced from SEQ ID NO: 16 which is drawn from residues 37111 to 37347 of contig 2 (SEQ ID NO: 6). Contig 3 (SEQ ID NO: 17) is formed of 8321 base pairs provided in SEQ ID NO: 17 and contains ORFs 8–15 of A541. The gene product of ORF 8 (SEQ ID NO: 18) is the 264 amino acids deduced from SEQ ID NO: 19 which is drawn from residues 57 to 851 of contig 3 (SEQ ID NO: 17). The gene product of ORF 9 (SEQ ID NO: 20) is the 331 amino acids of SEQ ID NO: 21 which is drawn from residues 863–1858 of contig 3 (SEQ ID NO: 17). The gene product of A541 ORF 10 (SEQ ID NO: 22) is the 262 amino acids deduced from SEQ ID NO: 23 which is drawn from residues 1855 to 2643 of contig 3 (SEQ ID NO: 17). The gene product of A541 ORF 11 (SEQ ID NO: 24) is the 319 amino acids deduced from SEQ ID NO: 25 which is drawn from residues 2713 to 3672 (sense strand) of contig 3 (SEQ ID NO: 17). The gene product of A541 ORF 12 (SEQ ID NO: 26) is the 353 amino acids deduced from SEQ ID NO: 27 which is drawn from residues 3672 to 4733 (sense strand) of contig 3 (SEQ ID NO: 17). The gene product of A541 ORF 13 (SEQ ID NO: 28) is the 283 amino acids of SEQ ID NO: 29 which is drawn from residues 4730 to 5578 (sense strand) of contig 3 (SEQ ID NO: 17). The gene product of A541 ORF 14 (SEQ ID NO: 30) is the 206 amino acids of SEQ ID NO: 31 which is drawn from residues 6263 to 5643 (anti-sense strand) of contig 3 (SEQ ID NO: 17). The gene product of A541 ORF 15 (SEQ ID NO: 32) is the 352 amino acids deduced from SEQ ID NO: 33 which is drawn from residues 7093 to 8151 (sense strand) of contig 3 (SEQ ID NO: 17).

Some open reading frames listed herein initiate with non-standard initiation codons (e.g. GTG—Valine or CTG—Leucine) rather than the standard initiation codon ATG, namely ORFs 1, 2, 4 and 13 (SEQ ID NOS: 2, 4, 9 and 28). All ORFs are listed with the appropriate M, V or L amino acids at the amino-terminal position to indicate the specificity of the first codon of the ORF. It is expected, however, that in all cases the biosynthesized protein will contain a methionine residue, and more specifically a formylmethionine residue, at the amino terminal position, in keeping with the widely accepted principle that protein synthesis in bacteria initiates with methionine (formylmethionine) even when the encoding gene specifies a non-standard initiation codon (e.g. Stryer, Biochemistry 3$^{rd}$ edition, 1998, W. H. Freeman and Co., New York, pp. 752–754).

Three deposits, namely E. coli DH10B (184CM) strain, E. coli DH10B (184CA) strain and E. coli DH10B (184CJ) strain harbouring the cosmid clone referred to in parenthesis which together span the biosynthetic locus for the A54145 compound from Streptomyces fradiae have been deposited with the International Depositary Authority of Canada, Bureau of Microbiology, Health Canada, 1015 Arlington Street, Winnipeg, Manitoba, Canada R3E 3R2 on Feb. 26, 2002 and were assigned deposit accession number IDAC 260202-1, 260202-2 and 260202-3 respectively. The E. coli strain deposits are referred to herein as "the deposited strains". The part of the A541 locus covered by each of the deposited cosmids 184CM, 184CA and 184CJ is indicated in FIG. 1.

In order to identify the function of the proteins in A541, SEQ ID NOS: 2, 4, 7, 9, 11, 13, 15, 18, 20, 22, 24, 26, 28, 30 and 32 were compared, using the BLASTP version 2.2.1 algorithm with the default parameters, to sequences in the National Center for Biotechnology Information (NCBI) nonredundant protein database and the DECIPHER® database of microbial genes, pathways and natural products (Ecopia BioSciences Inc. St.-Laurent, QC, Canada).

The accession numbers of the top GenBank hits of this BLAST analysis are presented in Table 2 along with the corresponding E value. The E value relates the expected number of chance alignments with an alignment score at least equal to the observed alignment score. An E value of 0.00 indicates a perfect homolog or nearly perfect homolog. The E values are calculated as described in Altschul et al. J. Mol. Biol., October 5; 215(3) 403–10. The E value assists in the determination of whether two sequences display sufficient similarity to justify an inference of homology.

TABLE 2

| A541 LOCUS | | | 024 LOCUS | | |
|---|---|---|---|---|---|
| ORF | SEQ ID NO | Family | ORF | SEQ ID NO | Family |
| 1 | 2 | ADLF | 1 | 35 | OXAU |
| 2 | 4 | PPST | 2 | 37 | ADLE |
| 3 | 7 | PPST | 3 | 39 | ACPH |
| 4 | 9 | PPST | 4 | 41 | PPST |
| 5 | 11 | PPST | 5 | 43 | PPST |
| 6 | 13 | PPST | 6 | 45 | PPST |
| 7 | 15 | UNKC | 7 | 47 | PPST |
| 8 | 18 | EATB | 8 | 49 | UNKC |
| 9 | 20 | OXAB | 9 | 51 | EATB |
| 10 | 22 | MTAG | 10 | 53 | OXAB |
| 11 | 24 | OXDD | 11 | 55 | MTAG |
| 12 | 26 | ABCD | 12 | 57 | OXDD |
| 13 | 28 | MEMD | 13 | 59 | ABCD |
| 14 | 30 | MEMT | 14 | 61 | MEMD |
| 15 | 32 | MTFZ | 15 | 63 | MEMT |
| | | | 16 | 65 | MTFZ |

TABLE 3

| ORF | Family | #aa | GenBank homology | probability | % identity | % similarity | proposed function of GenBank match |
|---|---|---|---|---|---|---|---|
| 1 | ADLF | 723aa | BAB69270.1,1261aa | 1e-108 | 261/629 (41.49%) | 320/629 (50.87%) | non-ribosomal peptide synthetase/ acyl-CoA dehydrogenase fusion, Streptomyces avermitilis |
| | | | NP_251114.1,4342aa | 1e-101 | 251/679 (36.97%) | 346/679 (50.96%) | non-ribosomal peptide synthetase, Pseudomonas aeruginosa |
| | | | AAG02359.1,2675aa | 1e-99 | 252/662 (38.07%) | 331/662 (50%) | peptide synthetase, Streptomyces verticillus |
| 2 | PPST | 3700aa | AAB96628.1,2638aa | 1e-200 | 1104/2699 (40.9%) | 1399/2699 (51.83%) | daptomycin biosynthetic protein subunit, Streptomyces roseosporus |
| | | | T36248,7463aa | 1e-200 | 1427/3817 (37.39%) | 1821/3817 (47.71%) | CDA peptide synthetase I, Streptomyces coelicolor |
| | | | CAC48360.1,3165aa | 1e-200 | 1145/3280 (34.91%) | 1499/3280 (45.7%) | peptide synthetase, Amycolatopsis mediterranei |
| 3 | PPST | 2595aa | NP_627443.1,7463aa | 1e-200 | 885/2056 (43.04%) | 1062/2056 (51.65%) | CDA peptide synthetase I, Streptomyces coelicolor |
| | | | T30874,1997aa | 1e-200 | 844/2048 (41.21%) | 1051/2048 (51.32%) | virginiamycin S synthetase, Streptomyces virginiae |
| | | | AAF42473.1,4247aa | 1e-200 | 1037/2569 (40.37%) | 1290/2569 (50.21%) | actinomycin synthetase III, Streptomyces chrysomallus |
| 4 | PPST | 2143aa | T36248,7463aa | 1e-200 | 912/2126 (42.9%) | 1150/2126 (54.09%) | CDA peptide synthetase I, Streptomyces coelicolor |
| | | | AAF42473.1,4247aa | 1e-200 | 842/2057 (40.93%) | 1075/2057 (52.26%) | actinomycin synthetase III, Streptomyces chrysomallus |
| | | | T30289,4848aa | 1e-200 | 822/2037 (40.35%) | 1040/2037 (51.06%) | pristinamycin I synthase 3, Streptomyces pristinaespiralis |
| 5 | PPST | 5245aa | NP_627444.1,3670aa | 1e-200 | 1681/3763 (44.67%) | 2059/3763 (54.72%) | CDA peptide synthetase II, Streptomyces coelicolor |
| | | | NP_522202.1,6889aa | 1e-200 | 1227/3370 (36.41%) | 1643/3370 (48.75%) | probable peptide synthase, Ralstonia solanacearum |
| | | | T14165,4976aa | 1e-200 | 1279/3790 (33.75%) | 1732/3790 (45.7%) | peptide synthetase homolog, Mycobacterium smegmatis |
| 6 | PPST | 2384aa | T36180,2117aa | 1e-200 | 939/2106 (44.59%) | 1156/2106 (54.89%) | CDA peptide synthetase III, Streptomyces coelicolor |
| | | | T30289,4848aa | 1e-200 | 854/1998 (42.74%) | 1056/1998 (52.85%) | pristinamycin I synthase 3, Streptomyces pristinaespiralis |

TABLE 3-continued

| ORF | Family | #aa | GenBank homology | probability | % identity | % similarity | proposed function of GenBank match |
|---|---|---|---|---|---|---|---|
| | | | AAF42473.1,4247aa | 1e−200 | 834/2008 (41.53%) | 1070/2008 (53.29%) | actinomycin synthetase III, *Streptomyces chrysomallus* |
| 7 | UNKC | 78aa | NP_336926.1,71aa | 2e−21 | 45/66 (68.18%) | 50/66 (75.76%) | mbtH protein, *Mycobacterium tuberculosis* |
| | | | AAL90876.1,69aa | 3e−21 | 43/64 (67.19%) | 50/64 (78.13%) | hypothetical protein, *Amycolatopsis orientalis* |
| | | | T36310,71aa | 3e−21 | 41/67 (61.19%) | 53/67 (79.1%) | hypothetical protein, *Streptomyces coelicolor* |
| 8 | EATB | 264aa | T36181,272aa | 4e−66 | 131/261 (50.19%) | 162/261 (62.07%) | probable hydrolase, *Streptomyces coelicolor* |
| | | | T30594,276aa | 2e−62 | 123/259 (47.49%) | 155/259 (59.85%) | hypothetical protein, *Amycolatopsis orientalis* |
| | | | CAC48368.1,284aa | 3e−62 | 121/258 (46.9%) | 156/258 (60.47%) | putative hydrolase, *Amycolatopsis mediterranei* |
| 9 | OXAB | 331aa | BAB69337.1,311aa | 1e−103 | 188/314 (59.87%) | 217/314 (69.11%) | SyrP-like protein, *Streptomyces avermitilis* |
| | | | AAG02342.1,328aa | 2e−52 | 120/301 (39.87%) | 163/301 (54.15%) | SyrP-like protein, *Streptomyces verticillus* |
| | | | BAB69339.1,311aa | 7e−45 | 107/289 (37.02%) | 148/289 (51.21%) | SyrP-like protein, *Streptomyces avermitilis* |
| 10 | MTAG | 262aa | NP_250992.1,2124aa | 1e−50 | 116/253 (45.85%) | 152/253 (60.08%) | probable non-ribosomal peptide synthetase, *Pseudomonas aeruginosa* |
| | | | AAC44360.1,260aa | 7e−37 | 100/250 (40%) | 125/250 (50%) | 31-O-demethyl-FK506 methyltransferase, *Streptomyces sp.* |
| | | | T30236,260aa | 4e−35 | 102/255 (40%) | 131/255 (51.37%) | methyltransferase, *Streptomyces hygroscopicus* |
| 11 | OXDD | 319aa | CAB92259.1,333aa | 1e−68 | 148/300 (49.33%) | 180/300 (60%) | putative oxygenase, *Streptomyces coelicolor* A3(2) |
| | | | A44241,324aa | 8e−38 | 110/297 (37.04%) | 146/297 (49.16%) | clavaminate synthase 1, *Streptomyces clavuligerus* |
| | | | B44241,334aa | 7e−35 | 102/295 (34.58%) | 143/295 (48.47%) | clavaminate synthase 2, *Streptomyces clavuligerus* |
| 12 | ABCD | 353aa | CAC22118.1,335aa | 2e−81 | 164/302 (54.3%) | 204/302 (67.55%) | ABC-transporter, *Streptomyces griseus* |
| | | | AAD44229.1,315aa | 1e−59 | 142/302 (47.02%) | 175/302 (57.95%) | DrrA, *Mycobacterium avium* |
| | | | CAC18704.2,335aa | 1e−59 | 141/303 (46.53%) | 183/303 (60.4%) | putative ABC transporter ATP-binding protein, *Streptomyces coelicolor* |
| 13 | MEMD | 282aa | CAC22119.1,268aa | 1e−39 | 90/260 (34.62%) | 135/260 (51.92%) | ABC-transporter, *Streptomyces griseus* |
| | | | NP_626506.1,274aa | 2e−18 | 59/254 (23.23%) | 100/254 (39.37%) | probable ABC-type transport protein, *Streptomyces coelicolor* |
| | | | P32011,283aa | 5e−17 | 63/226 (27.88%) | 96/226 (42.48%) | Daunorubicin resistance transmembrane protein, *Streptomyces peuceticus* |
| 14 | MEMT | 206aa | NP_301414.1,214aa | 2e−07 | 45/164 (27.44%) | 77/164 (46.95%) | putative membrane protein, *Mycobacterium leprae* |
| | | | ZP_00003411.1,232aa | 3e−07 | 26/102 (25.49%) | 52/102 (50.98%) | hypothetical protein, *Nitrosomonas europaea* |
| | | | CAB71913.1,231aa | 4e−06 | 35/131 (26.72%) | 57/131 (43.51%) | putative integral membrane protein., *Streptomyces coelicolor* A3(2) |
| 15 | MTFZ | 352aa | T36307,338aa | 4e−28 | 89/262 (33.97%) | 135/262 (51.53%) | hypothetical protein, *Streptomyces coelicolor* |
| | | | ZP_00102447.1,343aa | 8e−05 | 37/128 (28.91%) | 62/128 (48.44%) | hypothetical protein, *Desulfitobacterium hafniense* |
| | | | NP_104329.1,258aa | 1e−04 | 36/112 (32.14%) | 57/112 (50.89%) | ubiquinone/menaquinone biosynthesis methltransferase, *Mesorhizobium loti* |

EXAMPLE 3

Identification and Sequencing of the 024A Locus:

024A was identified as a secondary metabolic biosynthetic locus using the genome scanning method described in detail in U.S. Ser. No. 10/232,370, the contents of which are hereby incorporated by reference. The sequence information for 024A was then deposited into the DECIPHER® database of natural product biosynthetic genes, loci and products (Ecopia BioSciences Inc., St.-Laurent, Canada). 024A was identify from the DECIPHER® database as a lipopeptide biosynthetic locus using the method described in detail in co-pending application U.S. Ser. No. 10/329,027 entitled Compositions, Methods and Systems for the Discovery of Lipopeptides filed concurrently with the present application and also claiming priority from U.S. Ser. No. 60/342,133 and U.S. Ser. No. 60/372,789. The contents of U.S. Ser. No. 10/329,027 are incorporated herein in its entirety for all purposes.

EXAMPLE 4

Genes and Proteins for 024A

The 024A locus includes the 61944 contiguous base pairs provided in SEQ ID NO: 34 and contains the 16 ORFs provided SEQ ID NOS: 35, 37, 39, 41, 43, 45, 47, 49, 51, 53, 55, 57, 59, 61, 63 and 65. More than 16 kilobases of DNA sequence were analyzed on each side of the 024A locus and these regions contain primary metabolic genes. The order and relative position of the 16 ORFs representing the genes of 024A are provided in FIG. 2. The accompanying sequence listing provides the nucleotide sequence of the 16 ORFs and the corresponding deduced polypeptides.

The gene product of 024A ORF 1 (SEQ ID NO: 35) is the 573 amino acids deduced from SEQ ID NO: 36 which is drawn from residues 1 to 1722 (sense strand) of SEQ ID NO: 34. The gene product of 024A ORF 2 (SEQ ID NO: 37) is the 601 amino acids deduced from SEQ ID NO: 38 which is drawn from residues 2666 to 4471 (sense strand) of SEQ ID NO: 34. The gene product of 024A ORF 3 (SEQ ID NO: 39) is the 99 amino acids deduced from SEQ ID NO: 40 which is drawn from residues 4637 to 4936 (sense strand) of SEQ ID NO: 34. The gene product of 024A ORF 4 (SEQ ID NO: 41) is the 6291 amino acids deduced from SEQ ID NO: 42, which is drawn from residues 5061 to 23936 (sense strand) of SEQ ID NO: 34. The gene product of 024A ORF 5 (SEQ ID NO: 43) is the 2135 amino acids deduced from SEQ ID NO: 44, which is drawn from residues 23933 to 30340 (sense strand) of SEQ ID NO: 34. The gene product of 024A ORF 6 (SEQ ID NO: 45) is the 5245 amino acids deduced from SEQ ID NO: 46, which is drawn from residues 30337 to 46074 (sense strand) of SEQ ID NO: 34. The gene product of 024A ORF 7 (SEQ ID NO: 47) is the 2394 amino acids of SEQ ID NO: 48, which is drawn from residues 46074 to 53258 (sense strand) of SEQ ID NO: 34. The gene product of 024A ORF 8 (SEQ ID NO: 49) is the 78 amino acids deduced from SEQ ID NO: 50, which is drawn from residues 53262 to 53498 (sense strand) of SEQ ID NO: 1. The gene product of 024A ORF 9 (SEQ ID NO: 51) is the 271 amino acids deduced from SEQ ID NO: 52 which is drawn from residues 53687 to 54502 (sense strand) of SEQ ID NO: 34. The gene product of 024A ORF 10 (SEQ ID NO: 53) is the 318 amino acids deduced from SEQ ID NO: 54 which is drawn from residues 54499 to 55455 (sense strand) of SEQ ID NO: 34. The gene product of 024A ORF 11 (SEQ ID NO: 55) is the 269 amino acids deduced from SEQ ID NO: 56 which is drawn from residues 55540 to 56349 (sense strand) of SEQ ID NO: 34. The gene product of 024A ORF 12 (SEQ ID NO: 57) is the 319 amino acids deduced from SEQ ID NO: 58 which is drawn from residues 56448 to 57407 (sense strand) of SEQ ID NO: 34. The gene product of 024A ORF 13 (SEQ ID NO: 59) is the 340 amino acids deduced from SEQ ID NO: 60 which is drawn from residues 57407 to 58429 (sense strand) of SEQ ID NO: 34. The gene product of 024A ORF 14 (SEQ ID NO: 61) is the 282 amino acids deduced from SEQ ID NO: 62 which is drawn from residues 58426 to 59274 (sense strand) of SEQ ID NO: 34. The gene product of 024A ORF 15 (SEQ ID NO: 63) is the 205 amino acids deduced from SEQ ID NO: 64 which is drawn from residues 59924 to 59307 (antisense strand) of SEQ ID NO: 34. The gene product of 024A ORF 16 (SEQ ID NO: 65) is the 205 amino acids of SEQ ID NO: 66 which is drawn from residues 60814 to 61944 (sense strand) of SEQ ID NO: 34.

Some open reading frames listed herein initiate with non-standard initiation codons (e.g. GTG—Valine or CTG—Leucine) rather than the standard initiation codon ATG, namely ORFs 2, 5, 6 and 14 (SEQ ID NOS: 37, 43, 45 and 61). All ORFs are listed with the appropriate M, V or L amino acids at the amino-terminal position to indicate the specificity of the first codon of the ORF. It is expected, however, that in all cases the biosynthesized protein will contain a methionine residue, and more specifically a formylmethionine residue, at the amino terminal position, in keeping with the widely accepted principle that protein synthesis in bacteria initiates with methionine (formylmethionine) even when the encoding gene specifies a non-standard initiation codon (e.g. Stryer, Biochemistry $3^{rd}$ edition, 1998, W.H. Freeman and Co., New York, pp. 752–754).

Figure 2:
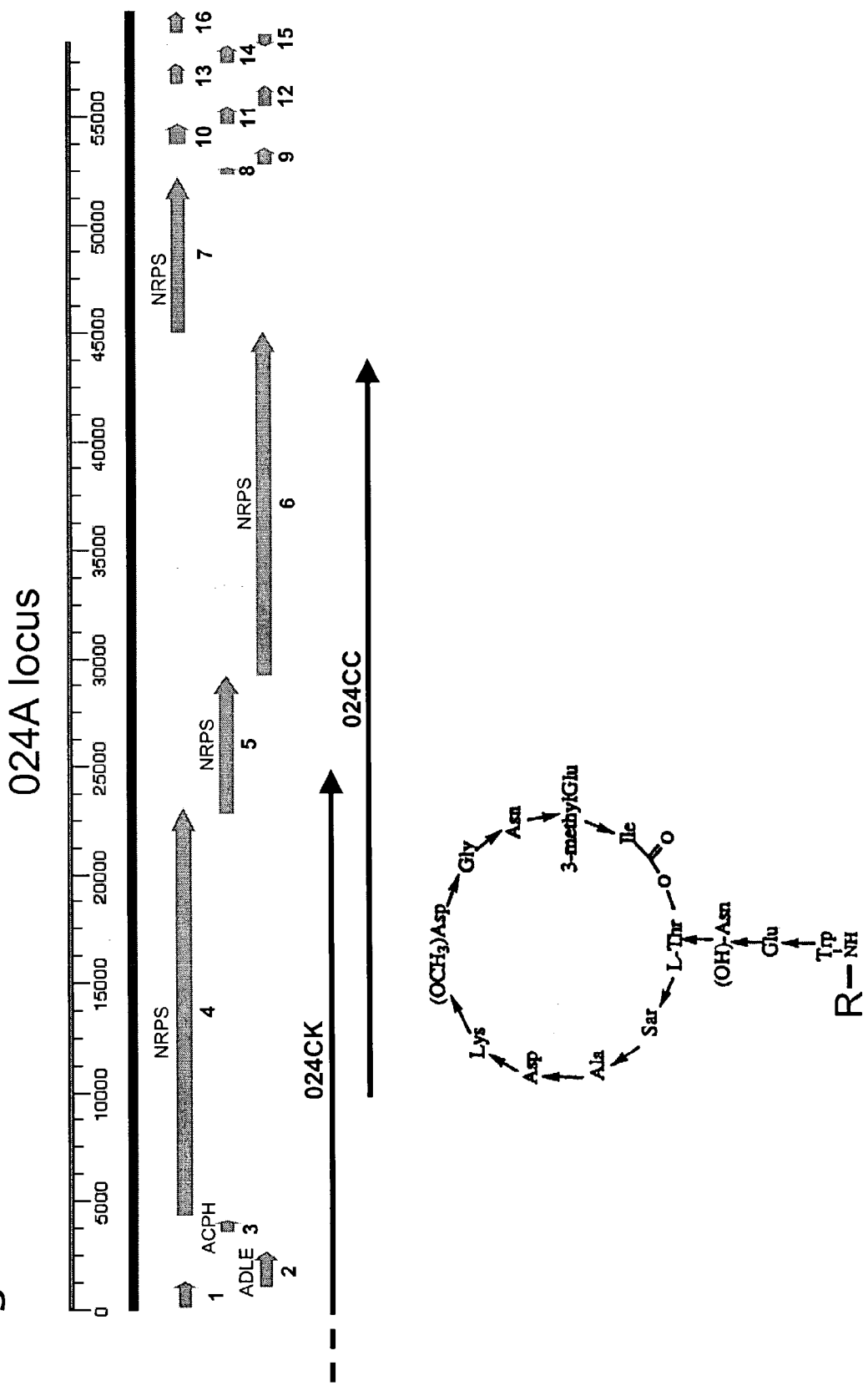
FIG. 2 is a graphical depiction of the 024A biosynthetic locus from *Streptomyces refuineus* NRRL 3143 showing, at the top of the figure, a scale in base pairs; the single continuous DNA sequence (SEQ ID NO: 34) represented by a continuous black line; the relative positioning and orientation of the 16 open reading frames by ORF numbers (SEQ ID NOS: 36, 38, 40, 42, 44, 46, 48, 50, 52, 54, 56, 58, 60, 62, 64 and 66); the regions covered by the deposited cosmid clones 024CC and 024CK; and a structure of the lipopeptide backbone and product of 024A.

Two deposits, namely *E. coli* DH10B (024CC) strain and *E. coli* DH10B (024CK) strain harbouring the cosmid clone referred to in parenthesis which together span the biosynthetic locus for the A54145-like compound from *Streptomyces refuineus* have been deposited with the International Depositary Authority of Canada, Bureau of Microbiology, Health Canada, 1015 Arlington Street, Winnipeg, Manitoba, Canada R3E 3R2 on Feb. 26, 2002 and were assigned deposit accession number IDAC 260202-4 and 260202-5. The *E. coli* strain deposits are referred to herein as "the deposited strains". The part of the A541 locus covered by each of the deposited cosmids 024CC and 024CK is indicated in FIG. 2.

The deposited cosmids 184CM, 184CA, 184CJ, 024CC and 024CK span A541 and 024A. The sequence of the polynucleotides comprised in the deposed strains, as well as the amino acid sequence of any polypeptide encoded thereby are controlling in the event of any conflict with any description of sequences herein. The deposit of the deposited strains have been made under the terms of the Budapest Treaty on the International Recognition of the Deposit of Microorganisms for Purposes of Patent Procedure. The deposited strains will be irrevocably and without restriction or conditions released to the public upon the issuance of a patent. A license may be required to make, use or sell the deposited strain and any compounds therefrom, and no such license is hereby granted.

In order to identify the function of the proteins in 024A, SEQ ID NOS: 35, 37, 39, 41, 43, 45, 47, 49, 51, 53, 55, 57, 59, 61 and 63 were compared, using the BLASTP version 2.2.2 algorithm with the default parameters, to sequences in the National Center for Biotechnology Information (NCBI) nonredundant protein database and the DECIPHER® database of microbial genes, pathways and natural products (Ecopia BioSciences Inc. St.-Laurent, QC, Canada). The accession numbers of the top GenBank hits of this BLAST analysis are presented in Table 4 along with the corresponding E value. The E value relates the expected number of chance alignments with an alignment score at least equal to the observed alignment score.

TABLE 4

| ORF | Family | #aa | GenBank homology | probability | % identity | % similarity | proposed function of GenBank match |
|---|---|---|---|---|---|---|---|
| 1 | OXAU | 573aa | NP_214745.1,568aa | 1e-172 | 313/571 (54.82%) | 381/571 (66.73%) | fadE4, *Mycobacterium tuberculosis* H37Rv |
|  |  |  | NP_214745.1,568aa | 1e-158 | 289/575 (50.26%) | 365/575 (63.48%) | acyl-coA dehydrogenase, *Archaeoglobus fulgidus* |
|  |  |  | NP_069334.1,576aa | 1e-147 | 269/570 (47.19%) | 364/570 (63.86%) | acyl-CoA dehydrogenase, *Leptospira interrogans* |

TABLE 4-continued

| ORF | Family | #aa | GenBank homology | probability | % identity | % similarity | proposed function of GenBank match |
|---|---|---|---|---|---|---|---|
| 2 | ADLE | 601aa | BAB69270.1,1261aa | 1e-112 | 257/594 (43.27%) | 322/594 (54.21%) | non-ribosomal peptide synthetase/acyl-CoA dehydrogenase fusion, *Streptomyces avermitilis* |
| | | | ZP_00110248.1,1204aa | 1e-103 | 224/569 (39.37%) | 320/569 (56.24%) | hypothetical protein, *Nostoc punctiforme* |
| | | | AAN85512.1,1745aa | 1e-102 | 242/578 (41.87%) | 307/578 (53.11%) | nonribosomal peptide synthetase, *Streptomyces atroolivaceus* |
| 3 | ACPH | 99aa | BAB69272.1,88aa | 4e-09 | 29/77 (37.66%) | 43/77 (55.84%) | hypothetical protein, *Streptomyces avermitilis* |
| | | | NP_488099.1,126aa | 2e-05 | 24/73 (32.88%) | 37/73 (50.68%) | unknown protein, *Nostoc sp.* |
| | | | AAF62883.1,7257aa | 2e-04 | 24/71 (33.8%) | 37/71 (52.11%) | epoD, *Polyangium cellulosum* |
| 4 | PPST | 6291aa | NP_627443.1,7463aa | 1e-200 | 2247/5847 (38.43%) | 2863/5847 (48.97%) | CDA peptide synthetase I, *Streptomyces coelicolor* |
| | | | AAM47273.1,6193aa | 1e-200 | 1647/4960 (33.21%) | 2091/4960 (42.16%) | peptide synthetase, *Saccharothrix mutabilis* |
| | | | AAB96628.1,2638aa | 1e-200 | 1108/2712 (40.86%) | 1415/2712 (52.18%) | daptomycin biosynthetic protein, *Streptomyces roseosporus* |
| 5 | PPST | 2135aa | T14070,1324aa | 1e-200 | 912/1329 (68.62%) | 964/1329 (72.54%) | peptide synthetase, *Streptomyces fradiae* |
| | | | NP_627443.1,7463aa | 1e-200 | 874/2118 (41.27%) | 1086/2118 (51.27%) | CDA peptide synthetase I, *Streptomyces coelicolor* |
| | | | AAF42473.1,4247aa | 1e-200 | 801/2040 (39.26%) | 1007/2040 (49.36%) | actinomycin synthetase III, *Streptomyces chrysomallus* |
| 6 | PPST | 5245aa | NP_627443.1,7463aa | 1e-200 | 2298/5342 (43.02%) | 2818/5342 (52.75%) | CDA peptide synthetase I, *Streptomyces coelicolor* |
| | | | ZP_00059518.1,3629aa | 1e-200 | 1440/3750 (38.4%) | 1810/3750 (48.27%) | hypothetical protein, *Thermobifida fusca* |
| | | | NP_251092.1,5149aa | 1e-200 | 1368/3977 (34.4%) | 1851/3977 (46.54%) | non-ribosomal peptide synthetase, *Psuedomonas aeruginosa* |
| 7 | PPST | 2394aa | CAD55498.1,2417aa | 1e-200 | 1104/2409 (45.83%) | 1344/2409 (55.79%) | CDA peptide synthetase III, *Streptomyces coelicolor* |
| | | | T30289,4848aa | 1e-200 | 890/2009 (44.3%) | 1091/2009 (54.31%) | pristinamycin I synthase 3, *Streptomyces pristinaespiralis* |
| | | | AAF42473.1,4247aa | 1e-200 | 857/2006 (42.7%) | 1091/2006 (54.39%) | actinomycin synthetase III, *Streptomyces chrysomallus* |
| 8 | UNKC | 78aa | AAL90876.1,69aa | 2e-23 | 46/64 (71.88%) | 55/64 (85.94%) | hypothetical protein, *Amycolatopsis orientalis* |
| | | | NP_627432.1,71aa | 2e-22 | 42/64 (65.63%) | 55/64 (85.94%) | hypothetical protein, *Streptomyces coelicolor* |
| | | | NP_336926.1,71aa | 1e-20 | 42/62 (67.74%) | 48/62 (77.42%) | mbtH protein, *Mycobacterium tuberculosis* |
| 9 | EATB | 271aa | NP_627445.1,272aa | 3e-79 | 150/271 (55.35%) | 187/271 (69%) | putative hydrolase, *Streptomyces coelicolor* |
| | | | CAC48368.1,284aa | 5e-67 | 130/265 (49.06%) | 164/265 (61.89%) | putative hydrolase, *Amycolatopsis mediterranei* |
| | | | NP_302477.1,265aa | 6e-54 | 111/255 (43.53%) | 150/255 (58.82%) | putative hydrolase, *Mycobacterium leprae* |
| 10 | OXAB | 318aa | BAB69337.1,311aa | 1e-117 | 203/287 (70.73%) | 231/287 (80.49%) | SyrP-like protein, *Streptomyces avermitilis* |
| | | | AAG02342.1,328aa | 2e-56 | 124/300 (41.33%) | 170/300 (56.67%) | SyrP-like protein, *Streptomyces verticillus* |
| | | | AAN85494.1,330aa | 5e-54 | 121/303 (39.93%) | 172/303 (56.77%) | regulatory protein, *Streptomyces atroolivaceus* |
| 11 | MTAG | 269aa | NP_250992.1,2124aa | 5e-46 | 106/253 (41.9%) | 147/253 (58.1%) | non-ribosomal peptide synthetase, *Pseudomonas aeruginosa* |
| | | | AAK19884.1,863aa | 4e-38 | 92/252 (36.51%) | 140/252 (55.56%) | methoxymalonyl-CoA synthase, *Polyangium cellulosum* |
| | | | AAF86398.1,260aa | 7e-34 | 98/254 (38.58%) | 132/254 (51.97%) | FkbM, *Streptomyces hygroscopicus* |
| 12 | OXDD | 319aa | NP_626927.1,333aa | 2e-73 | 158/313 (50.48%) | 190/313 (60.7%) | putative oxygenase, *Streptomyces coelicolor* |
| | | | A44241,324aa | 2e-37 | 108/297 (36.36%) | 147/297 (49.49%) | clavaminate synthase 1, *Streptomyces clavuligerus* |
| | | | CAA58905.1,325aa | 4e-32 | 97/299 (32.44%) | 142/299 (47.49%) | clavaminic acid synthase, *Streptomyces clavuligerus* |
| 13 | ABCD | 340aa | CAC22118.1,335aa | 9e-86 | 170/306 (55.56%) | 204/306 (66.67%) | ABC-transporter, *Streptomyces griseus* |
| | | | NP_626505.1,365aa | 1e-66 | 144/324 (44.44%) | 192/324 (59.26%) | ABC-transporter, *Streptomyces coelicolor* |
| | | | S32908,325aa | 7e-65 | 142/317 (44.79%) | 187/317 (58.99%) | hypothetical protein, *Streptomyces antibioticus* |
| 14 | MEMD | 282aa | CAC22119.1,268aa | 9e-30 | 72/217 (33.18%) | 109/217 (50.23%) | ABC-transporter, *Streptomyces griseus* |
| | | | NP_626506.1,274aa | 8e-12 | 49/221 (22.17%) | 82/221 (37.1%) | ABC-transporter, *Streptomyces coelicolor* |

TABLE 4-continued

| ORF | Family | #aa | GenBank homology | probability | % identity | % similarity | proposed function of GenBank match |
|---|---|---|---|---|---|---|---|
|  |  |  | S32909,273aa | 2e–11 | 52/221 (23.53%) | 83/221 (37.56%) | hypothetical protein, *Streptomyces antibioticus* |
| 15 | MEMT | 205aa | ZP_00003411.1,232aa | 3e–12 | 29/91 (31.87%) | 55/91 (60.44%) | hypothetical protein, *Nitrosomonas europaea* |
|  |  |  | NP_623431.1,209aa | 1e–11 | 39/128 (30.47%) | 66/128 (51.56%) | hypothetical protein, *Thermoanaerobacter tengcongensis* |
|  |  |  | NP_695703.1,241aa | 3e–10 | 29/91 (31.87%) | 48/91 (52.75%) | integral membrane protein, *Bifidobacterium longum* |
| 16 | MTFZ | 376aa | NP_627429.1,338aa | 1e–32 | 114/329 (34.65%) | 161/329 (48.94%) | hypothetical protein, *Streptomyces coelicolor* |
|  |  |  | ZP_00023003.1,272aa | 0.032 | 32/88 (36.36%) | 46/88 (52.27%) | hypothetical protein, *Ralstonia metallidurans* |

EXAMPLE 5

Biosynthesis of the A54145 Peptide Core Structure

While not intending to be limited to any particular mode of action or biosynthetic scheme, the gene products of the invention can explain the synthesis of A54145.

Five proteins, encoded by ORFs 2, 3, 4, 5 and 6 (SEQ ID NOS: 4, 7, 9, 11 and 13) are likely to be involved in the formation of the peptide core structure of A54145. These ORFs show significant similarity to peptide synthetases (NRPSs) or peptide synthetase domains. Table 5 shows the modules and the approximate boundaries of their domains as found in the 5 NRPS ORFs. Each module is composed of a condensation domain, an adenylation domain and a thiolation domain. In module 5, found in ORF 3, the adenylation domain is modified by the insertion of an N-methyltransferase domain commonly found in NRPS ORFs and responsible for methylation of the alpha-amino position of the amino acid activated by the module. Module 2, found in ORF 2, as well as modules 8 and 11 found in ORF 5, contain an additional domain responsible for epimerization of the amino acids activated by these modules, converting their stereochemistry form L- to D-form. The ultimate module 13, included in ORF 6, ends with a thioesterase domain catalyzing cyclization and release of the mature peptide core structure from the NRPS enzyme.

TABLE 6

A54145 NRPS domain coordinates

| ORF no. | Amino acid coordinates | Homology | Module no. |
|---|---|---|---|
| 1 | 41–648 | adenylating enzyme ("ADLE") | loading |
|  | 649–723 | acyl carrier protein ("ACPH") |  |
| 2* | 28–480 | condensation domain | 1 |
|  | 514–1003 | adenylation domain |  |
|  | 1007–1074 | thiolation domain |  |
|  | 1089–1544 | condensation domain | 2 |
|  | 1572–2080 | adenylation domain |  |
|  | 2084–2150 | thiolation domain |  |
|  | 2158–2665 | epimerization domain |  |
|  | 2667–3104 | condensation domain | 3 |
|  | 3129–3629 | adenylation domain |  |
|  | 3633–3698 | thiolation domain |  |
| 3** | 17–470 | condensation domain | 4 |
|  | 498–1011 | adenylation domain |  |
|  | 1012–1079 | thiolation domain |  |
|  | 1093–1549 | condensation domain | 5 |
|  | 1607–2482 | adenylation/N-methylation domains |  |
|  | 2487–2553 | thiolation domain |  |
| 4 | 9–451 | condensation domain | 6 |
|  | 473–974 | adenylation domain |  |
|  | 978–1045 | thiolation domain |  |
|  | 1060–1541 | condensation domain | 7 |
|  | 1566–2054 | adenylation domain |  |
|  | 2058–2125 | thiolation domain |  |
| 5 | 1–455 | condensation domain | 8 |
|  | 491–998 | adenylation domain |  |
|  | 1002–1068 | thiolation domain |  |
|  | 1071–1570 | epimerization domain |  |
|  | 1572–2014 | condensation domain | 9 |
|  | 2040–2534 | adenylation domain |  |
|  | 2538–2605 | thiolation domain |  |
|  | 2620–3080 | condensation domain | 10 |
|  | 3105–3614 | adenylation domain |  |
|  | 3618–3685 | thiolation domain |  |
|  | 3700–4161 | condensation domain | 11 |
|  | 4190–4679 | adenylation domain |  |
|  | 4683–4749 | thiolation domain |  |
|  | 4752–5245 | epimerization domain |  |
| 6 | 6–450 | condensation domain | 12 |
|  | 475–975 | adenylation domain |  |
|  | 979–1046 | thiolation domain |  |
|  | 1060–1520 | condensation domain | 13 |
|  | 1545–2034 | adenylation domain |  |
|  | 2038–2105 | thiolation domain |  |
|  | 2135–2383 | thioesterase domain |  |

*Partial ORF; N-terminus
**Partial ORF; C-terminus

Clustal alignment analysis of the NRPS domains revealed that all domains were complete and contained known motifs and conserved amino acid residues required for activity (FIGS. 3 to 7).

Analysis of the adenylation domains found in the NRPS ORFs allows the amino acid that is incorporated by each unit to be identified (see Table 6 and FIG. 13). The following amino acid specificities are consistent with these comparisons: ORF 2, module 1: tryptophan (Trp); ORF 2, module 2: glutamic acid (Glu); ORF 2, module 3: hydroxy-asparagine (HO-Asn)/asparagine (Asn); ORF 3, module 4: threonine (Thr); ORF 3, module 5: glycine (Gly); ORF 4, module 6: alanine (Ala); ORF 4, module 7: aspartic acid (Asp); ORF 5, module 8: lysine (Lys); ORF 5, module 9: O-methylated aspartic acid ($OCH_3$-Asp)/aspartic acid (Asp); ORF 5, module 10: glycine (Gly); ORF 5, module 11: asparagine (Asn); ORF 6, module 12: 3-methyl glutamic acid (3meGlu) and ORF 6, module 13: isoleucine (Ile).

TABLE 7

| | 235 | 236 | 239 | 278 | 299 | 301 | 322 | 330 | |
|---|---|---|---|---|---|---|---|---|---|
| ORF4_nAD03|024A|M3|Asn | D | L | T | K | V | G | D | V | ⎫ |
| ORF2_nAD03|A541|M3|Asn | D | L | T | K | V | G | D | V | ⎪ |
| ORF6_nAD04|024A|M11|Asn | D | L | T | K | V | G | D | V | ⎪ |
| ORF5_nAD04|A541|M11|Asn | D | L | T | K | V | G | D | V | ⎬ (OH)Asn/Asn |
| emb|CAB38517.1|Cda2|M3|Asn | D | L | T | K | V | G | E | V | ⎪ |
| gb|AAF08797.1|MycC|M2|Asn | D | L | T | K | I | G | E | V | ⎪ |
| gb|AAC45930.1|TycC|M1|Asn | D | L | T | K | I | G | E | V | ⎭ |
| ORF4_nAD04|024A|M4|Thr | D | F | W | S | V | G | M | V | ⎫ |
| ORF3_nAD01|A541|M4|Thr | D | F | W | S | V | G | M | V | ⎪ |
| emb|CAA72311.1|SnbC|M1|Thr | D | F | W | N | V | G | M | V | ⎬ Thr |
| gb|AAC80285.1|SyrE|M7|Thr | D | F | W | N | V | G | M | V | ⎪ |
| emb|CAB38518.1|Cda1|M2|Thr | D | F | W | N | V | G | M | V | ⎭ |
| ORF4_nAD05|024A|M5|Gly | D | I | L | Q | V | G | V | I | ⎫ |
| ORF3_nAD02|A541|M5|Gly | D | I | L | Q | V | G | V | I | ⎬ Gly(Sar) |
| emb|CAB38517.1|Cda2|M2|Gly | D | I | L | Q | V | G | L | I | ⎪ |
| gb|AAF17280.1|NosC|M2|Gly | D | I | L | Q | V | G | L | I | ⎭ |
| ORF5_nAD02|024A|M7|Asp | D | L | T | K | V | G | A | V | ⎫ |
| ORF4_nAD02|A541|M7|Asp | D | L | T | K | V | G | A | V | ⎪ |
| emb|CAB38518.1|Cda1|M5|Asp | D | L | T | K | I | G | A | V | ⎬ Asp |
| gb|AAF08797.1|MycC|M2|Asn | D | L | T | K | I | G | E | V | ⎪ |
| gb|AAC06348.1|BacC|M4|Asp | D | L | T | K | V | G | H | I | ⎭ |
| ORF6_nAD02|024A|M9|Asp | D | L | T | K | I | G | A | V | ⎫ |
| ORF5_nAD02|A541|M9|Asp | D | L | T | K | I | G | A | V | ⎪ |
| emb|CAB38517.1|Cda2|M1|Asp | D | L | T | K | I | G | A | V | ⎬ (OCH$_3$)Asp |
| gb|AAF08796.1|MycB|M2|Asn | D | L | T | K | I | G | E | V | ⎪ |
| gb|AACC6348.1|BacC|M5|Asn | D | L | T | K | I | G | E | V | ⎭ |
| ORF6_nAD03|024A|M10|Gly | D | I | L | Q | L | G | L | V | ⎫ |
| ORF5_nAD03|A541|M10|Gly | D | I | L | Q | L | G | L | V | ⎬ Gly |
| gb|AAF17280.1|NosC|M2|Gly | D | I | L | Q | L | G | L | I | ⎪ |
| emb|CAB38517.1|Cda2|M2|Gly | D | I | L | Q | V | G | L | I | ⎭ |
| ORF7_nAD02|024A|M13|Ile | D | G | L | F | V | G | I | A | ⎫ |
| ORF6_nAD02|A541|M13|Ile | D | G | L | F | V | G | V | A | ⎪ |
| gb|AAC06346.1|BacA|M5|Ile | D | G | F | F | L | G | V | I | ⎬ Ile |
| gb|AAC06346.1|BacA|M1|Ile | D | G | F | F | L | G | V | I | ⎪ |
| emb|CAA06325.1|LchAC|M1|Ile | D | G | F | F | L | G | V | V | ⎭ |
| ORF4_nAD01|024A|M1|Trp | D | V | A | L | A | G | V | V | Trp |
| ORF2_nAD01|A541|M1|Trp | D | V | A | L | V | G | V | V | |
| ORF4_nAD02|024A|M2|Glu | D | L | A | K | V | A | S | V | Glu |
| ORF2_nAD02|A541|M2|Glu | D | L | V | K | V | A | S | V | Glu |
| ORF5_nAD01|024A|M6|Ala | D | V | F | N | L | A | L | V | Ala |
| ORF4_nAD01|A541|M6|Ala | D | V | F | A | L | A | L | V | |
| ORF6_nAD01|A541|M8|Lys | D | A | W | D | A | G | T | V | Lys |
| ORF5_nAD01|024A|M8|Lys | D | A | W | D | A | G | T | V | |
| ORF7_nAD01|024A|M12|Glu | D | L | G | K | T | G | V | V | 3-methylGlu |
| ORF6_nAD01|A541|M12|Glu | D | L | G | K | T | G | V | V | |

Module 5 contains an adenylation-N-methyltransferase domain responsible for activation and tethering of glycine that is subsequently N-methylated to give the aminoacid sarcosine (Sar) found at amino acid position 5 in the A54145 mature peptide. In the mature A54145 peptide structure, glutamic acid as well as 3-methyl glutamic acid are found in position 12 indicating that module 12 is able to recognize and activate both amino acid structures. Alternatively, only glutamic acid is incorporated by module 12 and subsequently methylated to form 3-methyl glutamic acid as seen in the mature A54145 structure. Module 13 activates and incorporates two related amino acids, isoleucine and valine (Val), indicating that the adenylation domain contained in this module displays a certain flexibility for recognizing and activating both amino acids.

Figure 13B:
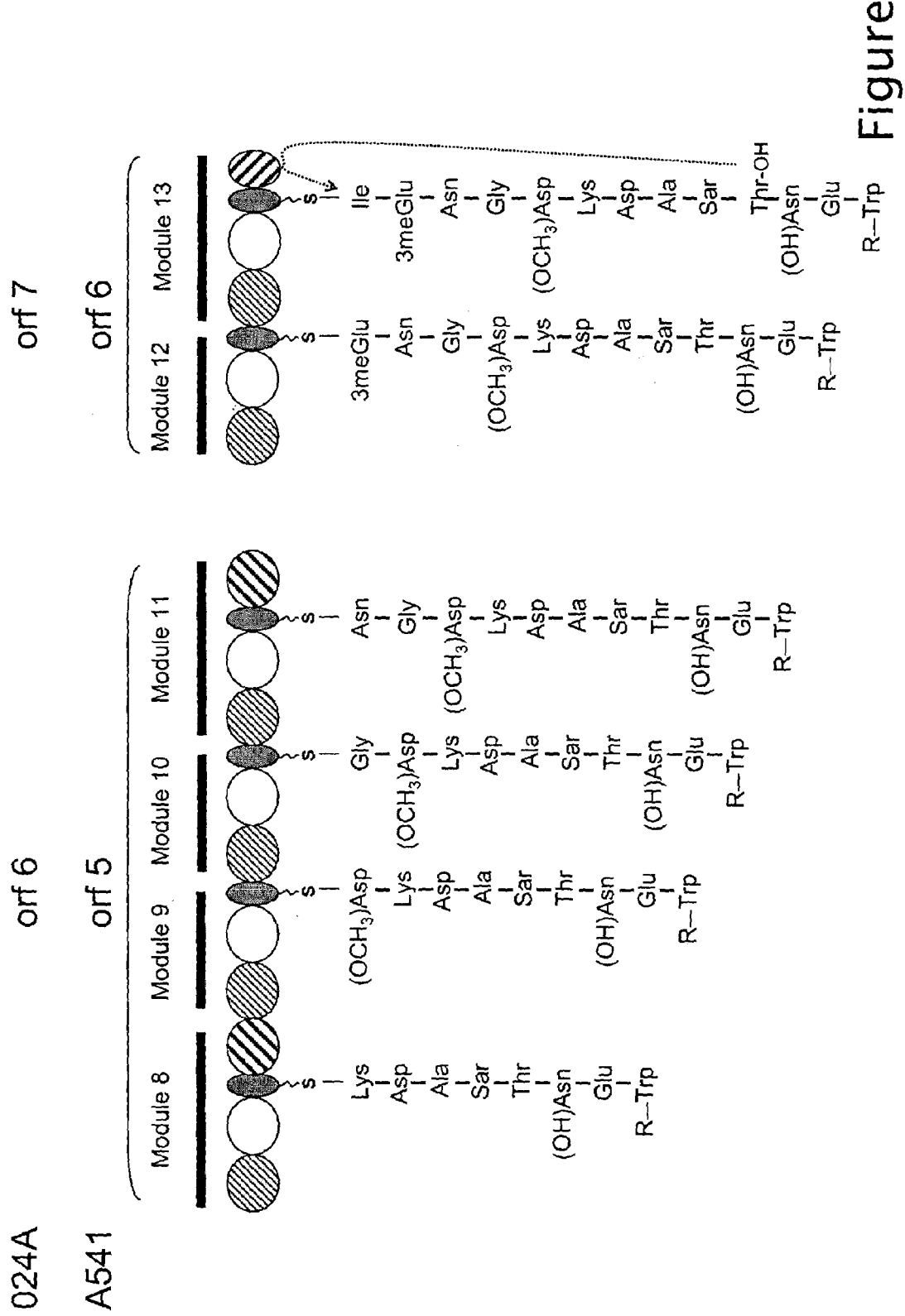

The mature peptide is released from the NRPS, enzyme (ORF 6) through the action of the thioesterase domain in module 13 with concomitant cyclization through esterification between the hydroxyl group of Thr at position 4 and the carbonyl group of Ile/Val residues at position 13 (FIG. 13b).

The order of modules as well as the predicted amino acid substrate specificities of the peptide synthetase repeating units are in precise agreement with the structure of the A54145 peptide core, providing conclusive evidence that the genetic locus described here is responsible for the biosynthesis of A54145 (FIGS. 1 and 13).

EXAMPLE 6

Biosynthesis of the 024A Peptide Core Structure

While not intending to be limited to any particular mode of action or biosynthetic scheme, the gene products of the invention can explain the synthesis of 024A product.

Four proteins, encoded by ORFs 4, 5, 6 and 7 (SED ID NOS: 41, 43, 45 and 47) are likely to be involved in the formation of the peptide core structure of the 024A product. These ORFs show significant similarity to peptide synthetases (NRPSs) or peptide synthetase domains. Table 7 shows the modules and the approximate boundaries of their domains as found in the 4 NRPS ORFs. Each module is composed of a condensation domain, an adenylation domain and a thiolation domain. In module 5, found in ORF 4, the adenylation domain is modified by the insertion of an N-methyltransferase domain commonly found in NRPS ORFs and responsible for methylation of the alpha-amino position of the amino acid activated by the module. Module 2, found in ORF 4, as well as modules 8 and 11 found in ORF 6, contain an additional domain responsible for epimerization of the amino acids activated by these modules, converting their stereochemistry form L- to D-form. The ultimate module 13, included in ORF 7, ends with a thioesterase domain catalyzing cyclization and release of the mature peptide core structure from the NRPS enzyme.

TABLE 7

024A NRPS domain coordinates

| ORF no. | Amino acid coordinates | Homology | Module no. |
|---|---|---|---|
| 2 | NA | adenylating enzyme ("ADLE") | loading |
| 3 | NA | acyl carrier protein ("ACPH") | loading |
| 4 | 6–443 | condensation domain | 1 |
|   | 477–970 | adenylation domain |   |
|   | 974–1041 | thiolation domain |   |
|   | 1056–1513 | condensation domain | 2 |
|   | 1541–2047 | adenylation domain |   |
|   | 2048–2114 | thiolation domain |   |
|   | 2127–2627 | epimerization domain |   |
|   | 2629–3071 | condensation domain | 3 |
|   | 3096–3597 | adenylation domain |   |
|   | 3601–3666 | thiolation domain |   |
|   | 3705–4164 | condensation domain | 4 |
|   | 4193–4706 | adenylation domain |   |
|   | 4707–4774 | thiolation domain |   |
|   | 4788–5244 | condensation domain | 5 |
|   | 5302–6179 | adenylation/N-methylation domains |   |
|   | 6184–6250 | thiolation domain |   |
| 5 | 9–449 | condensation domain | 6 |
|   | 475–974 | adenylation domain |   |
|   | 978–1045 | thiolation domain |   |
|   | 1060–1533 | condensation domain | 7 |
|   | 1558–2046 | adenylation domain |   |
|   | 2050–2117 | thiolation domain |   |
| 6 | 2–456 | condensation domain | 8 |
|   | 489–996 | adenylation domain |   |
|   | 1000–1066 | thiolation domain |   |
|   | 1074–1569 | epimerization domain |   |
|   | 1571–2010 | condensation domain | 9 |
|   | 2036–2530 | adenylation domain |   |
|   | 2534–2601 | thiolation domain |   |
|   | 2616–3076 | condensation domain | 10 |
|   | 3101–3608 | adenylation domain |   |
|   | 3612–3679 | thiolation domain |   |
|   | 3694–4156 | condensation domain | 11 |
|   | 4189–4678 | adenylation domain |   |
|   | 4682–4748 | thiolation domain |   |
|   | 4756–5245 | epimerization domain |   |
| 7 | 6–450 | condensation domain | 12 |
|   | 475–985 | adenylation domain |   |
|   | 986–1053 | thiolation domain |   |
|   | 1067–1527 | condensation domain | 13 |
|   | 1552–2046 | adenylation domain |   |
|   | 2050–2117 | thiolation domain |   |
|   | 2147–2392 | thioesterase domain |   |

Clustal alignment analysis of the NRPS domains revealed that all domains were complete and contained known motifs and conserved amino acid residues required for activity (FIGS. 8 to 12).

Analysis of the adenylation domains found in the NRPS ORFs allows the amino acid that is incorporated by each unit to be identified (see Table 6 and FIG. 13). The following amino acid specificities are consistent with these comparisons: ORF 4, module 1: tryptophan (Trp); ORF 4, module 2: glutamic acid (Glu); ORF 4, module 3: hydroxy-asparagine (HO-Asn)/asparagine (Asn); ORF 4, module 4: threonine (Thr); ORF 4, module 5: glycine (Gly); ORF 5, module 6: alanine (Ala); ORF 5, module 7: aspartic acid (Asp); ORF 6, module 8: lysine (Lys); ORF 6, module 9: O-methylated aspartic acid ($OCH_3$-Asp)/aspartic acid (Asp); ORF 6, module 10: glycine (Gly); ORF 6, module 11: asparagine (Asn); ORF 7, module 12: 3-methyl glutamic acid (3meGlu) and ORF 7, module 13: isoleucine (Ile).

Module 5 contains an adenylation-N-methyltransferase domain responsible for activation and tethering of glycine that is subsequently N-methylated to give the aminoacid sarcosine (Sar). The adenylation domain in module 12 recognizes and activates the same amino acid residue as the corresponding module in A54145 (Table 6). This observation indicates that a glutamic or 3-methyl glutamic acid residue could be found at position 12 in the structure of the 024A compound. Module 13 is highly homologous to the corresponding module in A54145 indicating that Ile and Val could be incorporated at this position in the 024A compound.

The mature peptide is released from the NRPS enzyme (ORF 7) through the action of the thioesterase domain in module 13 with possibly concomitant cyclization through esterification between the hydroxyl group of Thr at position 4 and the carbonyl group of Ile/Val residues at position 13 (FIG. 13b).

The order of modules as well as the predicted amino acid substrate specificities of the peptide synthetase repeating units are the same as in the A54145 locus providing evidence that the peptide core structure of the 024A compound is closely similar, if not identical, to the A54145 peptide core structure (FIGS. 1 and 13).

EXAMPLE 7

Activation of Fatty Acid Moieties in A54145 and 024A Compounds

Amino acid sequence homology analysis indicated that ORF 1 (SEQ ID NO: 2) in locus A541 as well as ORF 2 (SEQ ID NO: 37) in locus 024A are similar to acyl CoA ligases (ADLE), enzymes that activate acyl fatty groups and tether them to acyl carrier proteins (ACPH) (Tables 3 and 4). In A541, ADLE and ACPH family proteins are fused in one polypeptide (ADLF), as found in ORF 1 (SEQ ID NO: 2) whereas in 024A, ADLE and ACPH enzymes are separate (ORFs 2 and 3 with SEQ ID NOS: 37 and 39 respectively).

Conserved families of activating enzymes (ADLE) and acyl carrier proteins (ACPH) were also found in the ramoplanin locus (RAMO) from *Actinoplanes* sp. ATCC 33076 (ORF 26 and ORF 11 respectively) as described in detail in PCT/CA01/01462, in the A21978C locus (DAPT) from *Streptomyces roseosporus* NRRL 11379 (SEQ ID NOS: 26 and 40 respectively) and in the A41012 locus (A410) from the *Actinoplanes nipponensis* FD 24834 ATCC 31145 (SEQ ID NOS: 34 and 48 respectively) as disclosed in detail in U.S. Ser. No. 60/342,133 and in co-pending U.S. Ser. No. 10/329,027 entitled Compositions, Methods and Systems for the Discovery of Lipopeptides filed concurrently with the present application and also claiming priority from U.S. Ser. No. 60/342,133. RAMO and DAPT direct the synthesis of lipodepsipeptides similar in structure to that of A54145 (U.S. Pat. Nos. 4,427,656 and 4,208,403 respectively) whereas A410 directs the synthesis of a lipopeptide of unknown structure (U.S. Pat. No. 4,001,397). The only structural feature common to ramoplanin, A21978C and A54145 is a peptide backbone appended with a fatty acyl group at the N-terminal amino acid residue. Based on these correlations, ORF 1 (ADLF) in A541 and ORFs 2 and 3 in 024A are predicted to activate acyl fatty acids that are subsequently attached onto the peptide core structures to form the mature lipopeptide product.

The biological function of the ADLE, ADLF and ACPH ORFs was assessed by amino acid sequence similarity analysis. Clustal alignment of ADLE ORFs shows the conservation of domains and residues important for their enzymatic function (FIG. 14). Domain I, involved in AMP binding, and domains II and III, proposed to be involved in the formation of a hydrophobic pocket for the fatty acyl moiety, are highlighted (Fitzmaurice and Kolattukudy (1997) J. Bact. Vol. 179 pp. 2608–2615). Alignment of ACPH ORFs shows their overall sequence conservation and the absolute conservation of the serine residue that is modified by phosphopantetheinylation to form the active holoacyl carrier protein (FIG. 15).

EXAMPLE 8

Incorporation of Fatty Acid Moieties in A54145 and 024A Compounds

Figure 16:
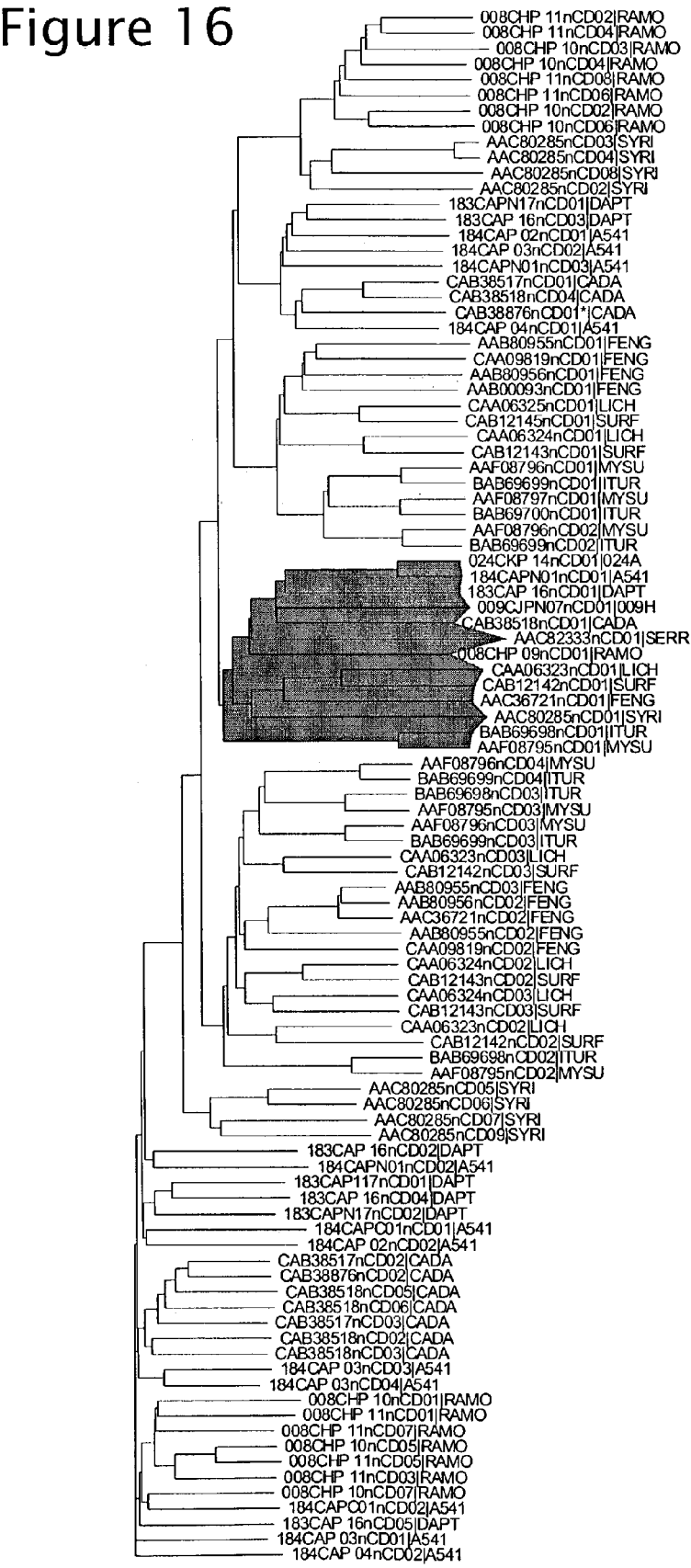
FIG. 16 is a dendrogram showing the evolutionary relatedness of C domains from various lipopeptide NRPSs with a clearly branching cluster of C domains involved in N-acylation highlighted in gray.

Closer examination of module 1 organization of ORF 2 (SEQ ID NO: 4) and ORF 4 (SEQ ID NO: 41) in A541 and 024A respectively shows that both NRPS modules begin with a condensation domain instead of the conventional adenylation-thiolation domains (Tables 5 and 7, and FIG. 13). A similar unusual organization is also found in the ramoplanin, A21978C and A41012 lipopeptide-specifying loci (supra). Such modules would generally be considered not to be capable of initiating peptide assembly on the assumption that the C-domain would likely interfere with this initiation process (see, for example, Linne and Marahiel, 2000, Biochemistry, Vol. 39, pp. 10439–10447). The nucleotide sequences of the members of the conserved family of unusual NRPS C-domains in RAMO, DAPT and A541, disclosed in detail as SEQ ID NOS: 5, 7 and 9 respectively in co-pending U.S. Ser. No. 10/329,027 entitled Compositions, Methods and Systems for the Discovery of Lipopeptides, as well as N-terminal C-domains from module 1 of ORF 2 in A541 and ORF 4 in 024A (Tables 5 and 7) were compared to a collection of condensation domains derived from various lipopeptide NRPSs obtained from GenBank or disclosed herein. FIG. 16 shows the evolutionary relatedness of these C-domains. Apart from RAMO, DAPT, A541, 024A, FIG. 16 refers to additional lipopeptide biosynthetic loci by way of a four letter designations wherein CADA is the biosynthetic locus for the calcium-dependent antibiotic, FENG is the biosynthetic locus for fengycin, SURF is the biosynthetic locus for surfactin, SYRI is the biosynthetic locus for syringomycin, SERR is the biosynthetic locus for serrawettin, LICH is the biosynthetic locus for lichenysin, ITUR is the biosynthetic locus for iturin, and MYSU is the biosynthetic locus for mycosubtilin. All C-domains included in this analysis are full-length C domains. The convention used to identify and distinguish C domains in FIG. 16 is as follows. Those NRPS C-domain sequences that were obtained from the GenBank database are denoted by accessions beginning with three letters and are followed by digits (usually numbering 5). These first eight characters identifying each of the C domains correspond to the GenBank accession number. The lower case "n" serves to denote "NRPS domain", and the "CD" followed by two digits denotes "C domain" and its number relative to the other C domains contained on that polypeptide sequence. For example "AAC80285nCD06|SYRI" represents the amino acid sequence corresponding to the sixth C domain contained on the GenBank entry AAC80285 for an NRPS from the syringomycin biosynthetic locus. The NRPS C domain sequences that are disclosed for the first time in this application, in U.S. provisional patent application Ser. No. 60/342,133 or U.S. patent application Ser. No. 09/976,059 follow a similar nomenclature (nCD00) but are denoted by nine-character accessions beginning with three numbers.

Analysis of a clustal alignment of the C-domains clearly shows that these domains are evolutionarily related to C-domains found in the starter modules of known N-acylated lipopeptides such as calcium-dependent antibiotic (CADA), surfactin (SURF), syringomycin (SYRI) and mycosubtilin (MYCO) among others (FIG. 16). Moreover, these special C-domains are significantly evolutionarily distant from regular condensation domains found in NRPSs that catalyze amide bond formation and condensation between two adjacent amino acids (FIG. 16). Alignment of these unusual C-domains demonstrates the conservation of motifs and specific amino acid residues important for their catalytic activity (FIG. 17). The conserved motifs C1 to C6, characteristic of condensation domains, are highlighted. The C7 motif in this specialized group of C domains is different to that previously reported and as such it is labeled C7' in FIG. 17. Based on these observations, the unusual C-domains are considered to catalyze N-acyl peptide linkages between a fatty acid and the amino terminal group of an amino acid.

EXAMPLE 9

Biosynthesis of N-acylated Peptides:

Despite the significant overall evolutionary distance between the lipopeptide-producing microorganisms described in this invention, they all contain closely related C-domains that are used for peptide N-acylation, a step which doubles as the peptide chain initiation step. Without intending to be limited to any particular biosynthetic scheme or mechanism of action, the ADLE/ADLF, ACPH and unusual NRPS C-domain, as exemplified by the first condensation domain in modules 1 of A541 and 024A, of the present invention can explain formation of the N-acyl peptide linkage found in lipopeptides.

Figure 18A:
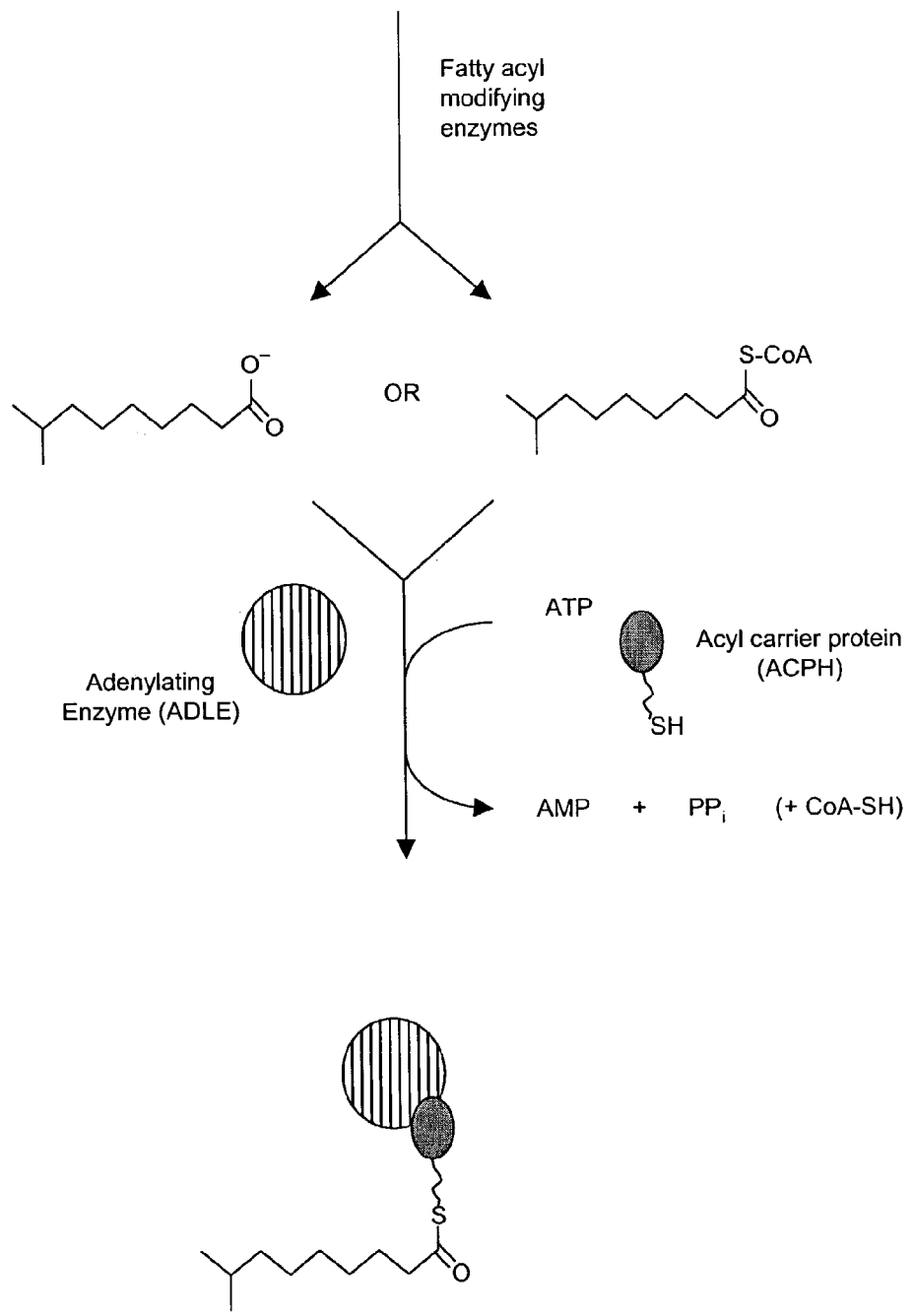
FIGS. 18a and 18b illustrate a mechanism for formation of N-acyl peptide linkage in lipopeptides.

FIGS. 18a,b illustrates a mechanism for NRPS chain initiation in which the fatty acyl group primes the synthesis of the peptide by the NRPS. CoA-linked fatty acyl precursors are channeled from the primary metabolic pool and modified while still attached to CoA by accessory enzymes such as oxidoreductases, epoxidases, desaturases, etc. encoded by genes of primary metabolism or by genes within the biosynthetic locus. The mature fatty acyl-CoA intermediate is then recognized by the cognate adenylating enzyme and transferred onto the phosphopantetheinyl prosthetic arm of the free holo-ACP, releasing CoA-SH and utilizing ATP in the process. It is alternatively contemplated that the adenylating enzyme may recognize free fatty acyl substrate(s) and transfer them onto the phosphopantetheinyl prosthetic arm of the free holo-ACP, utilizing ATP in the process. Once the fatty acyl group is tethered onto the free holo-ACP, the C domain of the first module carries out a reaction in which the carbonyl group of the activated fatty acyl is condensed with the amino group of the amino acid substrate that had been previously activated and tethered by the first module of the NRPS. Hence, peptide chain initiation and N-acylation are closely coupled. Subsequent peptide elongation and termination steps can then proceed as with typical NRPS modules.

Figure 18B:
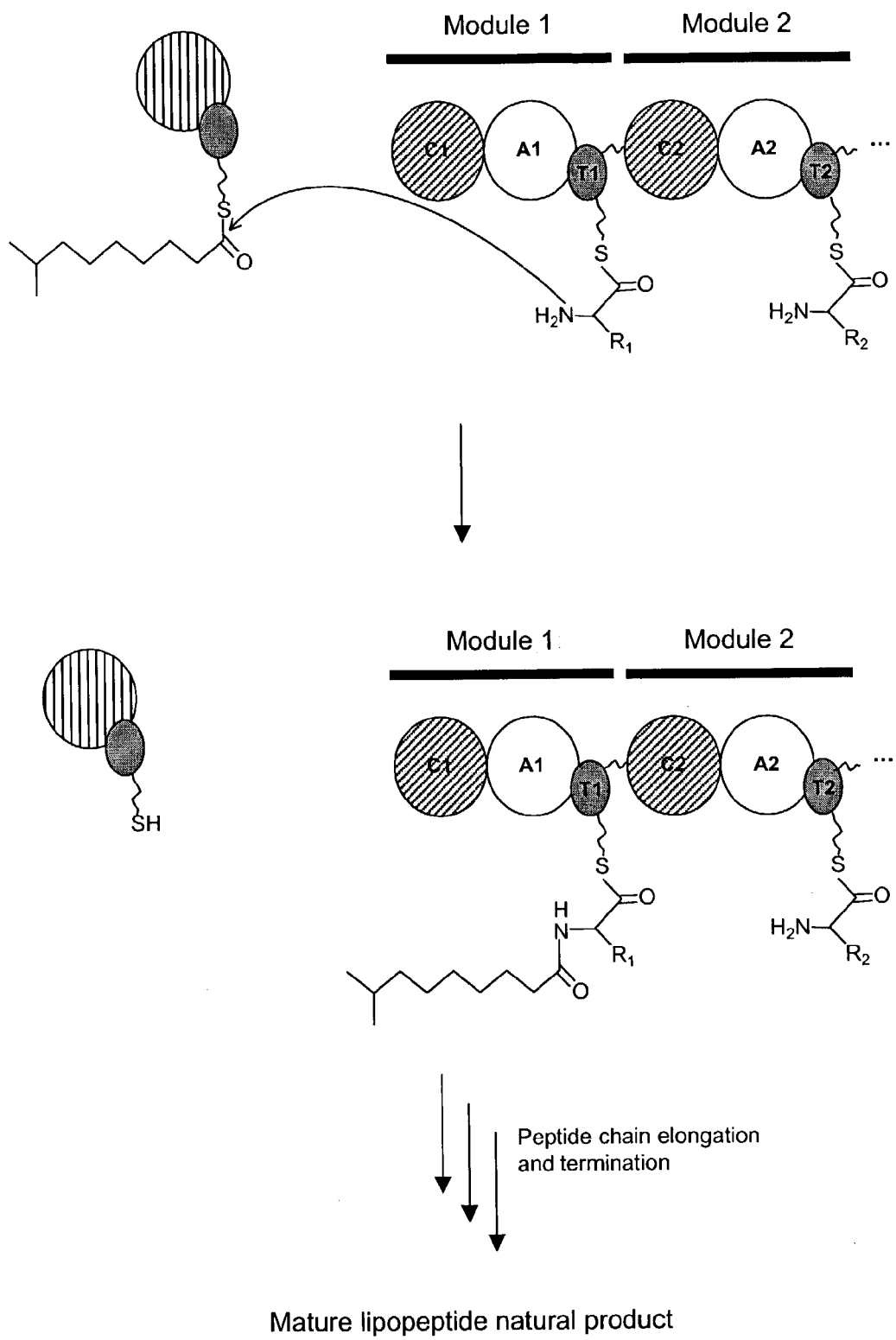
Figure 18C:
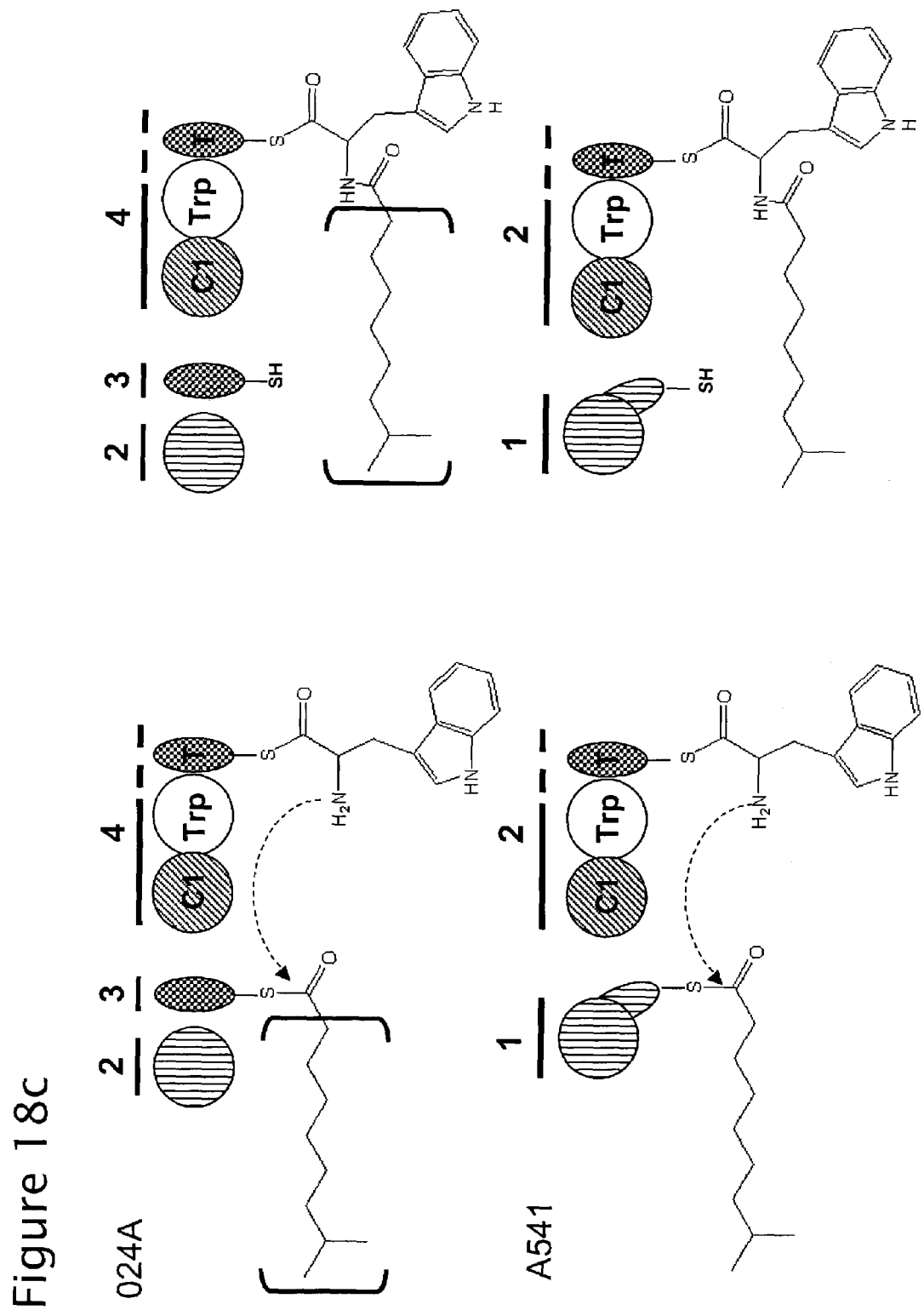
FIG. 18c illustrates the N-acylation mechanism specific for A54145 formation and corresponding mechanism describing the A54145-like compound generated by 024A. The fatty acid structure in brackets indicates that alternative fatty acids may be incorporated.

FIG. 18c illustrates the above-described amino acid N-acylation mechanism using specific examples in A541 and 024A lipopeptide biosynthetic pathways. In A54145, biosynthesis of the acylated peptide chain is initiated by activation and tethering of specific fatty acid units onto the ACPH component of the ADLF protein disclosed herein as ORF 1 (SEQ ID NO: 2). ADLF represents the fusion of the two protein families, ADLE and ACPH, required for activation of fatty acids in lipopeptide biosynthesis. Once the fatty acid is activated, the acyl-specific C-domain of the first module of ORF 2 (SEQ ID NO: 4) catalyzes the condensation of the carbonyl group of the fatty acyl and the amino group of the tryptophan residue (Trp) that had been previously activated by and tethered to the first module of the NRPS (FIGS. 13 and 18c). The A54145 factors vary with respect to various permutations of the identity of the fatty acyl moiety attached to the N-terminal amine of the peptide core (FIG. 1). The A54145 complex has eight factors composed of four different cyclic peptide cores and three different lipid side chains. Thus, eight of the possible twelve permutations of A54145 factors have been detected; presumably, the remaining four were present in such low amounts that they were not observed by the high-performance liquid chromatography (HPLC) system used. The variability in the fatty acyl group likely arises due to substrate flexibility in the adenylating enzyme/acyl carrier protein (ADLF) as well as the unusual C-domain in the first module of the A54145 lipopepetide NRPS.

In 024A compound biosynthesis, the ADLE enzyme (ORF 2; SEQ ID NO: 37) activates specific fatty acid moieties and subsequently tether them onto the phosphopantetheinyl prosthetic arm of the ACPH (ORF 3; SEQ ID NO: 39). The carbonyl group of the activated fatty acyl is then condensed to the amino group of the tryptophan residue (Trp) that had been previously activated by and tethered to the first module of the NRPS. The condensation reaction is catalyzed by the acyl-specific C-domain of module 1 in ORF 4 (SEQ ID NO: 41) (FIGS. 13 and 18c).

The same mechanism for peptide N-acylation may be present in other microorganisms. Evidence supporting this hypothesis includes the fact that other lipopeptide NRPS enzymes that have been identified in very diverse microorganisms contain a specialized C domain in the first module. Examples include the syringomycin biosynthetic locus from *Pseudomonas syringae* pv. *syringae* (Guenzi at al. (1998) *J. Biol. Chem.* Vol. 273, pp. 32857–32863); the serrawettin W2 biosynthetic locus from *Serratia liquefasciens* MG1 (Lindum et al. (1998) Vol 180, pp. 6384–6388); the fengycin biosynthetic loci from *Bacillus subtilis* b213 and A1/3 (Steller et al. (1999) *Chem. Biol.* Vol. 6, pp. 31–41); the surfactin biosynthetic locus from *Bacillus swotilis*; the lichenysin biosynthetic locus from *Bacillus licheniformis* (Konz et al. (1999) *J. Bact.* Vol. 181, pp. 133–140); and the "calcium-dependent antibiotic" (CADA) biosynthetic locus from *Streptomyces coelicolor* A3(2) (Hajati et al. (2002) *Chem. Biol.* Vol. 9, pp. 1175–1187). The CADA biosynthetic locus does not apparently have an adenylating enzyme homologue but it does contain a free acyl carrier protein that may participate together with the unusual C domain of the first NRPS module in the N-acylation mechanism. Therefore, certain fatty acids may require specialized enzymes to transfer the fatty acyl moiety onto the acyl carrier protein, but once tethered onto the free acyl carrier protein the mechanism is analogous to that outlined in FIG. 18. It is noteworthy to point out that the fatty acyl moiety of CDA is unique in that it contains an epoxy modification. Hence such fatty acids may be transferred onto the ACP by some other specialized enzyme.

It is possible that the N-acylation mechanism of the present invention extends beyond bacteria to even more diverse microorganisms such as lower eukaryotes and other organisms. For example, the fungi *Aspergillus nidulans* var. *roseus, Glarea lozoyensis*, and *Aspergillus japonicus* var. *aculeatus* are known to produce the antifungal lipopeptides echinocandin B, pneumocandin B0, and aculeacin A, respectively (Hino et al. (2001) *Journal of Industrial Microbiology and Biotechnology* Vol 27, pp. 157–162). Based on the overall similarity between fungal and bacterial NRPS systems and on the fact that we have shown that very diverse NRPS systems employ the same mechanism of N-acylation, the mechanism of peptide N-acylation described in this invention is likely to be operative in these and/or other lipopeptide-producing lower eukaryotes as well.

Although the disclosed mechanism for peptide N-acylation is apparently widespread among very diverse microorganisms, it is not the only means by which lipopeptides can be generated. For example, the lipopeptides mycosubtilin and iturin A produced by *Bacillus subtilis* ATCC and RB14, respectively, are each assembled by multifunctional hybrid polypeptides comprising fused fatty acid synthase, amino transferase, and NRPS activities (Duitman et al. (1999) *Proc. Natl. Acad. Sci USA*. Vol. 96, pp. 13294–13299; Tsuge et al. (2001) *J. Bact*, Vol. 183, pp. 6265–6273). This alternative mechanism of peptide N-acylation may be more evolutionarily restricted as, to the best of our knowledge, it has been identified only in members of the genus *Bacillus*, and the lipopeptides produced by these biosynthetic loci are members of a distinct sub-group of lipopeptides that contain a β-amino fatty acyl moiety linked to the amino terminus of the peptide core. Despite the fact that this mechanism of N-acylation does not involve the action of ADLE and ACPH homologues, the C-domains that condense the β-amino fatty acyl moiety to the first amino acid of both mycosubtilin and iturin are found to cluster within the highlighted group of acyl-specific C-domains as shown in FIG. 16.

\The widespread N-acylation mechanism for peptide natural products provides a knowledge-based approach for discovery and identification of lipopeptide biosynthetic loci in microorganisms. The highly conserved nucleotide sequences that are distinguishing signatures of the adenylating enzyme, the acyl carrier protein, and/or the specialized C-domain involved in the N-acylation mechanism can be identified and utilized as probes to screen libraries of microbial genomic DNA for the purpose of rapidly identifying, isolating, and characterizing lipopeptide biosynthetic loci in microorganisms of interest. The sequences of ADLE, ACPH proteins and the acyl-specific C-domain can also be used for in silico screening of large collections of microorganisms. Such a genetic-based screen has the added advantage over traditional fermentation approaches in that organisms having the genetic potential to produce lipopeptide natural products can be identified without the laborious fermentation, isolation, and characterization of the lipopeptide natural product. In addition, those organisms that normally produce lipopeptides only at very low or undetectable amounts or those organisms that only produce lipopeptides under very specialized growth conditions can nevertheless be readily identified using this genetic approach.

EXAMPLE 10

Methylation of Glutamic Acid at Position 12 of A54145 and 024A Compounds:

The amino acid in the $12^{th}$ position of the A54145 peptide core can be either glutamate or 3-methyl-glutamate. Four of the eight known A54145 factors, A, $A_1$, D, and F, contain glutamate and the other four, B, $B_1$, C, and E, contain 3-methyl-glutamate in the $12^{th}$ position. Based on our in silico analyses, ORF 15 (SEQ ID NOS: 32) is predicted to be responsible for the formation of the 3-methyl-glutamate-containing A54145 factors. ORF 15 is structurally related to the S-adenosylmethionine-dependent ubiquinone (coenzyme Q)/menaquinone (vitamin K2) family of C-methyltransferases (pfam01209) (Table 3).

An equivalent methyltransferase is found in locus 024A (ORF 16, SEQ ID NO: 65) indicating that a similarly modified amino acid is found in the structure of the 024A compound (Table 4 and FIG. 13).

A search of the NCBI gene database identified a homologue with 35% identity to ORF 15 in *Streptomyces coelicolor* A3(2), hypothetical protein SCE8.08c (GenBank accession CAB38586). Further inspection of the genetic context of the gene encoding SCE8.08c revealed that it is located approximately 20 kilobasepairs upstream of the NRPS genes that are responsible for the production of the "calcium-dependent antibiotic" (CADA) of *S. coelicolor* and less than 3.5 kilobasepairs upstream of the gene encoding the CdaR transcriptional activator protein for CADA biosynthesis. CADA is an example of an N-acylated lipopeptide and, significantly, it too varies at one position of the peptide core in that either glutamate or 3-methyl-glutamate is found in the $10^{th}$ position of the eleven amino acid core. In an elegant study using microarray expression profile analysis, Huang and coworkers recently demonstrated that the gene encoding hypothetical protein SCE8.08c is among those that are expressed coordinately along with the CADA NRPS cluster (Huang et al. (2001) Genes Dev. Vol. 15 pp. 3183–3192). This finding supports our hypothesis implicating hypothetical protein SCE8.08c in the formation of 3-methyl-glutamate-containing CADA compounds. In contrast to the function which we propose here for hypothetical protein SCE8.08c, Ryding and coworkers have recently suggested that it is involved in the synthesis of tryptophan, a precursor used in the biosynthesis of CADA which is incorporated at both the third and eleventh positions. Their conclusion was based merely on the fact that the SCE8.08c gene is one of the six genes, most of which are homologues of known tryptophan biosynthetic genes, that is expressed as an operon transcribed from a single promoter known as p7 (Ryding (2002) J. Bact. Vol. 184 pp. 794–805). We disagree with these authors' proposed function for SCE8.08c as no C-methyltransferase is required in the tryptophan biosynthetic pathway.

The lipopeptide antibiotic A-21978C complex (daptomycin is one of the factors in this complex) produced by *S. roseosporus* is yet another example of a lipopeptide natural product that contains a 3-methyl-glutamate in the peptide core and shares the common features described above for A54145 and CADA. As expected by our predictions, a homologue with 38% identity to ORF 15 has been identified in *S. roseosporus* and the gene encoding this polypeptide is located less than 3 kilobasepairs downstream of the A-21978C NRPS biosynthetic genes (data not shown). However, to our knowledge no variants of A-21978C containing glutamate instead of 3-methyl-glutamate have been isolated from cultures of *S. roseosporus*. Perhaps this indicates a tighter coupling between expression and/or activity levels of the C-methyltransferase and the NRPS machinery in *S. roseosporus* than either *S. fradiae* or *S. coelicolor*. Alternatively, it is possible that *S. roseosporus* does produce variants of A-21978C containing glutamate instead of 3-methyl-glutamate but the extraction processes have eluded to identify these compounds.

Therefore, we propose that ORF 15 of the A54145 locus, ORF 16 of the 024A locus and their homologues in *S. coelicolor* and *S. roseosporus* constitute a novel family of C-methyltransferases (herein termed MTFZ) that give rise to NRPS-generated peptides containing 3-methyl-glutamate. FIG. 19 is an amino acid alignment of ORF 15 from the A54145 locus and ORF 16 from the 024A locus together with the CADA-associated homologue of *S. coelicolor* and the A-21978C-associated homologue of *S. roseosporus*. Three motifs of sequence similarity in S-adenosylmethionine-dependent methyltransferases (Kagan and Clarke (1994) Arch Biochem Biophys 1994 Vol. 310, pp. 417–427) are highlighted. The crystal structure determination of catechol O-methyltransferase has identified the amino acids immediately following motif II as playing an important role in the binding of ligands and in forming the enzymatic active site (Vidgren et al. (1994) Nature Vol. 368 pp. 354–358). The post-motif II region among the members of the MTFZ family includes a highly conserved motif, AYGTHH, which may play an analogously important role in the binding of ligands and in forming the enzymatic active site. Moreover, this highly conserved post-motif II region may be diagnostic of this novel class of C-methyltransferases.

The exact substrate and the timing with which ORF 15 in the A541 locus methylates it have yet to be determined. It has been shown, however, that A54145 factors containing glutamate at position 12 accumulate more rapidly and earlier during fermentation than those containing 3-methyl-glutamate at position 12. Moreover, varying the temperature of the fermentation can modulate the ratios of glutamate- to 3-methyl-glutamate-containing factors (U.S. Pat. No. 4,994, 270). At lower temperatures (21 degrees Celsius), the majority of the products were factors containing glutamate at position 12 whereas at higher temperatures (33 degrees Celsius) the majority of the products were factors containing 3-methyl-glutamate at position 12. One explanation for this temperature-dependent variation of the residue at position 12 is that the catalytic activity of ORF 15 is higher at elevated temperatures. Alternatively, expression levels of ORF 15 may be higher at elevated temperatures. For example, one possibility for the latter scenario is if a transcriptional repressor regulates expression of ORF 15 and this repressor is, in turn, temperature sensitive such that its function is compromised at elevated temperatures.

Having identified the functional relevance of this novel class of C-methyltransferase, one skilled in the art may engineer strains—by means of traditional strain improvement or by targeted genetic modification—to enrich or produce exclusively A54145 factors that are more desirable. For example, if A54145 factors containing glutamate at position 12 are desired over those containing 3-methyl-glutamate at position 12, one could genetically engineer a recombinant strain in which the ORF 15 gene is disrupted so as to eliminate the methylation step. Conversely, if A54145 factors containing 3-methyl-glutamate at position 12 are desired over those containing glutamate at position 12, one could genetically engineer a recombinant strain that overproduces the ORF 15 gene (for example, by introducing a second copy of the gene on a high copy number plasmid) so as to increase the efficiency of the methylation step.

EXAMPLE 11

Biosynthesis of an N-acylated Lipopeptide by Locus 024A

Locus 024A in *Streptomyces refuineus* subsp. *thermotolerans* NRRL 3143 was shown to possess several characteristics of an N-acylated lipopeptide encoding locus, namely the presence of an acyl-specific C-domain in module 1 of ORF 2 (Table 7) located at the N-terminus of the first NRPS ORF involved in the assembly of the polypeptide, ADLE (ORF 2) and ACPH (ORF3) family proteins (SEQ ID NOS: 37 and 39 respectively) as well as an NRPS multienzymatic system composed of 13 modules (see Table 7 and FIG. 13). The high homology of the NRPS systems found in loci 024A and A541 suggests that the 024A polypeptide scaffold is identical to that of A54145 (FIG. 13).

Based on these observations and on the fact that there are known growth conditions for expressing lipopeptide A54145 in *Streptomyces fradiae* (U.S. Pat. No. 4,977,083), *Streptomyces refuineus* subsp. *thermotolerans* was grown under identical culture conditions to assess possible induction of locus 024A and determine the nature of the specified product.

*Streptomyces fradiae* and *Streptomyces refuineus* subsp. *thermotolerans* were grown at 30° C. for 48 hour in a rotary shaker in 25 mL of a seed medium consisting of glucose (10 g/L), potato starch (30 g/L), soy flour (20 g/L), Pharmamedia (20 g/L), and $CaCO_3$ (2 g/L) in tap water. Five mL of this seed culture was used to inoculate 500 mL of production media in a 4L baffled flask. Production media consisted of glucose (25 g/L), soy grits (18.75 g/L), blackstrap molasses (3.75 g/L), casein (1.25 g/L), sodium acetate (8 g/L), and $CaCO_3$ (3.13 g/L) in tap water, and proceeded for 7 days at 30° C. on a rotary shaker. The production culture was centrifuged and filtered to remove mycelia and solid matter. The pH was adjusted to 6.4 and 46 mL of Diaion HP20 was added and stirred for 30 minutes. HP20 resin was collected by Buchner filtration and washed successively with 140 mL water and 90 mL 15% $CH_3CN/H_2O$, and the wash was discarded. HP20 resin was then eluted with 140 mL 50% $CH_3CN/H_2O$ (fraction HP20 E2). This pool was passed over a 5 mL Amberlite IRA68 column (acetate cycle) and the flow through (fraction IRA FT) was reserved for bioassay. The column was washed with 25 mL 50% $CH_3CN/H_2O$ and eluted with 25 mL 50% $CH_3CN/H_2O$ containing 0.1 N HOAc (fraction IRA E1 ), and then eluted with 25 mL 50% $CH_3CN/H_2O$ containing 1.0 N HOAc (fraction IRA E2). Biological activity was followed during purification by bioassay with *Micrococcus luteus* in Nutrient Agar containing 5 mM $CaCl_2$.

FIG. 20 is a photograph of a plate generated during extraction of an anionic lipopeptide from *Streptomyces fradiae*. FIG. 20a shows an enrichment of activity based on IRA67 anion exchange chromatography consistent with expression of an acidic lipopeptide. This activity is concentrated during the extraction procedure as indicated by the increased diameter of lysis rings. A54145 was detected via HPLC/MS in fraction IRA E2 as evidenced by mass ion $ES^{2+}=830.5$ consistent with the structures of A54145C,D (U.S. Pat. No. 4,994,270).

FIG. 20b is a photograph of a plate generated during a similar extraction scheme performed on extracts from *Streptomyces refuineus* subsp. *thermotolerans*. FIG. 20b shows a similar enrichment of activity based on IRA67 anion exchange chromatography consistent with expression of an acidic lipopeptide. This activity is concentrated during the extraction procedure as indicated by the increased diameter of lysis rings. A mass ion of $ES^{2+}=830.5$, identical to that of A54145, was present in fraction IRA E2 confirming that an N-acylated acidic lipopeptide, identical to A54145C,D, is produced by 024A in *Streptomyces refuineus* subsp. *thermotolerans*.

EXAMPLE 12

Use of the N-acyl Capping Cassette to Engineer Peptide Synthetases Capable of Producing Novel Lipopeptides The availability and understanding of lipopeptide N-acyl capping components increases the potential of redesigning (un)natural products by engineered peptide synthetases. It has been demonstrated that, using known molecular biology techniques, functional hybrid peptide synthetases may be engineered that are capable of producing rationally designed peptide products (Mootz et al. (2000) *Proc. Natl. Acad. Sci. USA*. Vol 97 pp. 5848–5853). Moreover, it has been postulated that through domain swapping, change-of-substrate specificity by mutagenesis, and an induced termination to achieve release of a defined shortened product, it may be possible to obtain a recombinant NRPS system that produces antipain, a potent cathepsin inhibitor produced by *Streptomyces roseus* and whose biosynthetic machinery is unknown (Doekel S, Marahiel M A. (2001) *Metab. Eng*. Vol 3 pp. 64–77). Mootz et al. (supra) described genetic engineering using an NRPS system to produce a peptide product that is not a naturally occurring product, and Doekel and Marahiel (supra) described a prophetic example of engineering an NRPS system to make the known natural product antipain.

The following outlines a strategy whereby the NRPS biosynthetic machinery of a nonlipopeptide natural product, complestatin, can be modified so as to produce an N-acylated analogue of complestatin (FIG. 21).

*Streptomyces lavendulae* produces complestatin, a cyclic peptide natural product that antagonizes pharmacologically relevant protein-protein interactions including formation of the C4b, 2b complex in the complement cascade and gp120-CD4 binding in the HIV life cycle. Complestatin, a member of the vancomycin group of natural products, consists of an alpha-ketoacyl hexapeptide backbone modified by oxidative phenolic couplings and halogenations. The entire complestatin biosynthetic and regulatory gene cluster spanning ca. 50 kb was cloned and sequenced (Chiu et al. (2001) *Proc. Natl. Acad. Sci. USA* Vol 98 pp. 8548–8553). It includes four NRPS genes, comA, comB, comC, and comD (FIG. 10, panel a). The comA gene encodes an NRPS that is composed of a loading module that incorporates hydroxyphenylglycine (HPG; or a derivative thereof) followed by a module that incorporates tryptophan (Trp), the first two residues of complestatin. Through domain swapping, the loading module and the C domain of the tryptophan-incorporating module can be replaced by one of the acyl-specific C-domains disclosed herein. Preferably, the acyl-specific C-domain of A541 (in module 1 of ORF 2—SEQ ID NO: 4), DAPT, or 024A (in module 1 or ORF 4—SEQ ID NO: 41) would be used, as these domains are naturally specific for condensing an acyl moiety to a tryptophan residue. In addition to this domain swapping, the ADLE and ACPH genes would also be introduced into the system so as to provide a means to generate activated acyl substrates that can be used by the acyl-specific C domain. Thus, FIG. 21b depicts a rationally designed recombinant NRPS system that should give rise to N-acylated complestatin analogue(s). The recombinant NRPS system depicted in FIG. 21b could be employed either in vivo, using an appropriate recombinant host or in vitro using purified enzymes supplemented with the appropriate substrates.

One approach whereby N-acylated complestatin analogue(s) could be generated in vivo would involve the use of *Streptomyces lavendulae*, the complestatin producer, as the host strain. Briefly, the N-acyl capping cassette would replace the comA gene. This could be accomplished either by inactivation of the comA gene on the *Streptomyces lavendulae* chromosome followed by the introduction of a plasmid expressing the ADLE, ACPH, and the recombinant ComA derivative, or by physically replacing, by way of a double recombination (Keiser et al., supra) the comA gene on the *Streptomyces lavendulae* chromosome by a cassette containing genes encoding the ADLE, ACPH, and the recombinant ComA derivative. The resulting recombinant strains could be further modified to include genes involved in the biosynthesis of the acyl moieties and/or could be provided acyl moieties or precursors thereof in the fermentation medium.

One approach whereby N-acylated complestatin analogue(s) could be generated in vitro would involve the over-expression of the ADLE, ACPH, recombinant ComA, ComB, ComC, and ComD polypeptides in an appropriate host, for example *E. coli*, followed by the preparation of an extract or purified fraction thereof and use of said preparation together with appropriate substrates as outlined in Mootz et al. (2000). It is expected that, in the absence of accessory proteins the product produced by this in vitro system might not contain certain modifications such as the cross-linking of residues that is catalyzed by specific complestatin cytochrome P450 enzymes.

SEQUENCE LISTING (66 sequences)

SEQ ID NO: 1 - DNA, 13315 bp, Streptomyces fradiae
ttgaccgtccgggcggagcaccggaaagcgtcgaccctgccgccggggaacccggccgtcagcagcggcgactccgcgtcccgccgggagaagagggccgccgctgggagcagttcttcggcggacccgctggccggcccccacctggtggccgcgatctccgcgacggccgaggccgacccggggcgcaaggccgtcggtctcgtccgggatccggagcgcgagggcgaggaggcgctgcggagctacgcctggctcgacgacaccgcccgccgcatcgccgtcctcctgcgtgcggccgggctggaaacgggcgcacgcgtgctgctgctcttcccgcagtccgcggagttcgcggcggcctacgccgggtgtctctacgcgggcatggttgccgtccccgcgccccttccgaccggcacctcccatgaggccgcacgcgtcgtcggcatcgcgaaggactccgaggcaggcgccgtcctcaccgtctccgaaaccgaggcggacgtccggcaatgggcggcccgcaccggcctgggcgcgctgcccctccactgcgtcgacgaactgcccggcgacgccgaccccgacacgtggcgggaaccggagatccgggccgacaccgtggcggtcctccagtacacctccggctccaccggcagccccaagggggtcgtcgtcacccacggcgcgctcgccgacaacgtgcgcagcctgctcacgggcttcgatctgggatccggcgcccggctgggcggctggctgccgatgtaccacgacatggggctgttcggcctgctgagcccggcactgttcagcggcggagccgccgtgctgatgagcggcagcgccttcctgcgccgcccgtcccagtggctgaggctgatcgaccgcttcggcctcgtcttctcggcggcgcccgacttcgcctacgactactgcgtacggcgggtgagacccgaggagacggacgggctcgacctgtcgcgctggcgctgggcggccaacggctccgagcccatccgcgccgagacgctgcgcgccttcgccaaggagttcgccccggccggactccacccgaacgccaccaccccttgctacggactggccgaggcgaccctgctggtgtccctgcccacgggtgagctgcgcacccgacgggtggacgtcgcggaactggagaaccaccgcttcgtcgaagcggccgtgggacgcccctcccgcgagatcgtgtcctgcggccggcccccgtccctggagatccgcgtcgtcgaccccgcgaccggcaagtccgtcacgggcggcgacggagccggcgagaccagggtgggcgagatcagagtgcgcggcgcgagcgtcgccaggggctactggcagaaaccggaggcgaccgccgagacgttcgtcatggacgcggacggctccgggccctggctgcgcaccggcgacctcggcgctctgtacgagggcgagctgtacgtcaccggccgtatcaaggaactcctcatcgtgcacggccgcaacatctacccccatgacatcgagcacgaactgcgcgcccgccacgccgaactcggcgctgtcggggccgccttctccctcagcaccgaatcgggcgaggttgtggtcgtcacccatgaggtgaaccccaccgtccggcccgagcagggtcccgagctggtgaccgccctgcgtgcgacgctcgcgcgggagttcggcctcgccccggccggggtggtgctggtgcgccgcggccgcatcccgcgcaccagcagcggcaaggtgcaacgccgcctgaccgcccggctgttcagcacgggggaactcgcccaggtccatgccgaccccggcgcccaccgcctcctggcggaactcagggaggcgcacgaccgcggcggcgccttcccgcccccctccccgcccgccagccaggaccccgaggccctgcggcagcggctgcgcgagctgtgcgccgactgtctcggcgtccccgtggactccctcgccacggacgcccccctcaccgactacgggatgacctccgtcaccggcaccgccctgtgcgggatggtggaggagtacctggacgtcgaatgcgacctggaactgctctggcaggagccgacgatcgacgggctcgcctcccggctggcctcgcgcaccgtgcgctgaccgtcgccggccccctccgcaccacgcgcccgtgccccggcacgtgtgcgcccggacacctccgcgcgtccggcggtgccgcccccttcagcccgagagcgggagaagcatgttggagtcctcggcacaccgtgtggccgccacgtcggcccagaccgggatctggacggcgcagcgtctgcgcggggacgacaggctctacgcctgcggcctcttcctcgaactcgaccacgtggtggaggaggtgctgagcgaggcgatccgccgcgccgtcgccgacaccgaggcgctgcgcaccgcgttccgggaggacgcggacggcgcgctggagcagcacgtcctcgcccggccgccgagcacgcagacccgcctcttccacgccgacccgagcggcggaaccccctcccgctccgcgtccctggactggatggaccggcaacgggcgcaaccctgggacctcgcgtcgggcgacacctgccgtcataccctgatccccctcggcggcgaccgctcgctgctgcacctgcgttaccaccacctcgccctggacgggtacggcgccgcgctctatctggaccggctcgcggcggtctaccgcgcgctgcgcaccggccatcaaccgcccccctgcgcgttcgcgccgctggcccgcctggtcgaggaggaccacgcctaccggaactccgcccgtcaccgcgcggacgccaatcactggcgcgaccgcttcgcggacctcccgcgccccaccagcctcgccgacgccaccacgcccgcggcgcccaccacgcccgccacgcccgccgcgcccgccgcgcccgacgaactgcggcgcaccgtgcgcctgtccgccgcccggtccgccgcgctgcgccgtgcctcggaccggagcggccgaccctggcccgtgtacgccacggccgcggtggccgccttcctgagccgactcgcgccgggggaggaggtcgtcgtcggcctcccggtcaccgccagggtgacccccgccgcggtgcgcacaccggggatgctcgccaacgtcgtaccgcttcgcctgcccgtccggcagggcatgtcgacggcggagctgctggagctgaccgcggccgagatcagcaccacactgcgccaccagcgccaccgcaccgaggacatcgggcgggcgctcggactccacggcgctccgccagccaccacactcgtgaacgtcatggcgttcgccccggtcctcgacttcggcgactgccgggccccggtgcaccagctctcggccggaccggtggaggacctggtcgtcaacctcctcggcaccccgggcgacggcggcgagagcgacggcaccgagctggagatcactgtcgccgccaacccccgcctccactcggcggacgcggtggcctcgctggccgcgcggctcgcggagttcctcacgcacatggggcaggacgccgaggcgcccctcggccggacccggctgctcgacgcggaggaggaggtcgcggcggtggcccgcgggcacagtccccgacgcgacctgcgcgcccggaccctgcccgagctcttcgcccggcaggtcgcccgcaccccggacgcccccgccgtctcctcggaccgcgccacctggacgtacgcccaactcgacgcccacgccgagagagtggcccggcggctcgccgcgcggggcgtgggaccggagagcctcgtcgccctcgcggtgccgcggggcgtcgagctggcggcgctgatcctcgggatccagcgggccggaggggcctacctccccatcgacccggagtacccggcggaacgcgtcggtttcctgctgcgcgacgcccgccccgccctgctcgtcggcgggacggggaccgagccctccgccgccgactgcccgcgcgtgccggccgaagagctcctcgacgccggggcgtgccgcgccgaggccgacgtgcccccgcccggaagcctcccggtggaccttccggcgtacgtcgtccacacctccggctcgaccgggcggcccaagggggtggtggtcacccacgcgggcatcgccgccctggcggccgagcagatcgaacgctaccgactgggacccggctccagggtggcgcagctggcggccctcgggttcgacgtcgcggtcgccgaactcgtgatggcgctggcgtcggggagctgtctcgtcctcccgccgcacggcctcgccggcgacgagctggcctccttcctgcgcgaccggcgtatcaccacggccctcgccccggccgccgtactggccaccctgccccccggcgacctccccgacctgaccgatctggtcaccggaggcgagcagccaccgcccgcgctgatcgcccgctgggcacccggccggcggatgttcaacgtctacgggccgacggaggccaccgtccaggccacctccgggcggtgcgcggccgacggcgaccggtcgccggacatcgggaaccccgaggccggagtggacgcctacgttctggacgccgcgctgcgacccgtgcccgacggggtgacgggcgagctctacctgcgtggcaggggcctggcccgcggctacctcggccgccccggcctcaccgccggccggttcgtcgccgacccccacaccgggacgggcgagcggatgtacaggaccggggacctggtgcgccgggtgcccggcgacggccgcaccgtgctgaggttcgtcggccgggccgacgaccaggtgaagatccggggcttccgggtcgagccgggcgaggtcgaggccgccctcgccgaactcgacggcgtcgagcaggccctggtgaccgtccgggaggagcggcccggcgaccgcaggctcgtcggctacctgacacccgcccccgggcaccggggatcactggacgtcgagcgcctgcgccgcgtgctcgccgaccggctccccgcccacctcgtcccctccctcctgatggagctggcggagatcccgcgcaccgccaacggcaaggtggaccgtgcggcgctgccggaccccgctcccctggccccgaccgccgggagggcgccgcgcgacgcccgagaagaggccctgtgcgcgctcttcgccgaggtgctgggcgtcgaggaggtcggcgtcgacctcgacttcttcgcgctgggcggtgactcgctgctggccgcccgactggcgagccgcatccgtggccggctgggcaaggcggtcaccgtacgggaggtcttccggtccccgaccgtcgcccgcctcgcggaggaactgggcgacggggccgtgccggacgaccacgtccgtcccgtccggccccgcccggagcggctgccgctgtcgtccgcgcagcgccggctgtggttcatcgacgaactcaacggcgcgtcggcggcctacaacatcccgaccgtcctccacctggagggaccgctcgacgtccccgcgctgcacgccgcgctcggcgacgtgacggaccggcacgaaacgctccgcaccaccctgcggccccccgcggacgacggctcggcgggcgcacccgagcagcacatcgcgccccccggcggccaccggccaccgctgccggtgctcgacgtcgctcccgaagcgctcgccggggagctgcgcgccgcagcgggccacgtcttcgacctcgcgcgggaccttccggtgcgcgccacgctctaccgcaccggcgagctggagcacgcgctgctgctgctggtccatcacgtcgccgccgacggcgcgtcgatgggccccctgatcggcgacctggccaccgcctacacggcccggctcgcgggacgcgcacccgtcctcccgccacccgaggtgacgtacgccgacttcgcgctgtgggagcgggggagccgggagcgctccgccgcgcaggccgaggggatcgactactggcgccgggccctggccgggctgccggaccacatccggctccccgccgaccgcccccgctcgcaggaaccggtccgccgcggcgggatcgcccggttcgaggtgccgcccgccctgtacgccgggctcgtggagctggcccaaggcgtcggcgccaccccgttcatggtgctccagaccgcgatagccgtcctgctcagccggatgggagccggaaccgacatccccctgggcacgccggtcgccggccgccaggacgaggcgctcgacggactcgtcggctgcttcgtcaacaccgtcgtcctgcgcaccgacgtctcgggtgaccccaccacgaccgaactgctggcccggacgcgcgacggcgacctggaagccctcgcccaccaggacgtgcccttcgaccgggtcgtggaggcggtcaaccccgtccgttccacctcacggcaccccctcttccaggtcatgctgatcctcaacggttctgatcaggaccggcaccgggcgcggttcccccgactggccgaccgggtcgagacggtggagccgggggagaccaagttcgacctctcctggcacttcacccaccgcgacgggccggacaggtcgctggagggggccctcgtccacgccgccgacctgttcgacgacgacaccgcgcaccggctcaccgcacgcctgctcgacgtcctgaccgccatggtcgacgaccccgcccggcccgtcgggaccatcgacgtcctcagcgccgccgagcaccgcctcgtgcgcgcgtgggggaccggcacgccccgcccccctggcagccgtccggagccggtcgccgcgaggatcgccggccaggccgcccgcacaccggacgcccccgcggtgaccgagcccggacgggtctggagctacgccgaactcgacgcccgcgccgaccgggtggcggcggccctggccgcacgcggaatcggcgccgaggacctcgtcgccgtactcctgccccgcggcgcggaactggtcgccaccctgctggggatcctccgggcaggcgccgcctacctcccgctcgacaccggacaccccgccgaccgcaaccgccgggccctctccgactccgccccggcactgctggtgaccgacgccgggcggtcgcgcacgctccgaggagagaccgggtgcgccgcgctggtcctgggtgcggaggacaccgagcgggaactggcggaccgcgcccccctcccgcgggacggcgccggcctcgtacgcccggtgaccggggacaacgccgcctacacgatcctcacctccggttcgacgggccgccccaaggccgtcgtcgtgacgcgggacgcgctggacgcgttcgtcgatcgcgccctggacacctacggcgacgcgctgggcggagaggctctgctgcactccccggtcgccttcgacctcacggtcgtcaccctgtacgggccgctggccgcgggcgggcgcgtccgggtcggcgacctcgacgagtccgggatcgcccggtgggagaaggagcgcccggccttcgtcaaggccacgccctcccacctcgcgctgctgacggagttcggcggctccacggcccccggaacggtcgtcctggcgggcgagcaactcatcggcgcacggctggaccgctggcggactcgcctgggcgcctccggcaccaccgtcctcaacagctacgggcccaccgagaccaccgtcaactgcctggagcacaggatcgccccggacgccgacgtgccctcgggacccgtgccggtgggccggccggtgcccggggtacgggtgctgctcctcgacgaccgcctgcgccccgtcgccccgggcgtcacgggcgaactgtatgtctgcgggcccggcgtcgcccgcggataccgtgccaggccggccgccaccgccgaacggttcgtcgcctgtccgcaaggacggccgggagagcggatgtaccgcaccggcgacctgatgcgctggaccgccgacggcgaactggtctacgagggacgggccgacgcccaggtgaaggtgcgcggcttccgggtcgagcccggcgaggtggaggccgcgctgctcggcctccccggcgtccgcgaggccgccgtcaccctcctggaagggccggaaggaacggaagggccggaaggggcgcccgggagggtggccgcccccgcccgcctcgtcggctacgtcgtcggcgccagcgaggaaccggccgccctcctcgaacggctgcgcgtcaggttgcccgaccacatggtgcccgccgccctcgtggacctcgacgccctgccgctcaccccgaacggcaagctcgaccgccgcgccctgcccgcccccgacttcggccgccacgcgggccgccgcgcacccagcgggccggaggaggaagcgctctgcgcgctcttcgccgacgtgctgggagtgcccgaggtcggcgcggacgacagcttcttcacgctcgggggcgacagcatcgtcagcatccagctcgtcggccgcgcccggggagccggactgcacctcacggtgcgcgacgtcttcgagcaccccacggccgccgggctggcgaccgtcgtccggtccgccggaccggacgcggacgcggagcgtcccgcgccgcaggcgctcgccccgagcgggacgctgccctacgtcccggccgcggcgcggctcgtggccagaaccggctcgatgcgcgcccgcggcgccgaccgcttccaccagtcggtggtcctcaccaccccggcgaacgcggcggccgacgacgtccggcgcgtgctccagacgctgatcgaccatcacggggcactccgcctgcggaccgccgccgaccgggacggatcgccggacggcctggtgatcaccgaaccggggacggtcgccgccgccggcctgctgcgctgccgcgacgccgccggactccagggcgtggctctgcgggaggcggtggagcgggaggccgggcacgcacgcgacgccctcgacccgagcaccggggccgtgctgcgcgcggcctggctggaccgggggaaggaccggctcggcctgctggtcctggtggcccaccacctcagcgtggacggcgtctcctggcgcatcctggcggacgacctccgccaggcatggaccccggccgacgcccccgccacgacggcgaccctgccgccggagggcgcttccctgcgggagtgggccacccggatcgcccggcgcgccaccgagaccgccgtgaccggccggcttccccactggcgcgcgaccctggccggcctcgacgacccggacggcgacgtggtcgccctggagacccggctcgaccccgaggccgacacccacggcacggcgcgcgagcacgcgcacggcctgtcacccgacctgaccgacgcgctcgtgcgcaccgcgcccgcggcgctgcgcgcggacaccggcgaactgctgctggccgcctacgcgctcgccgcgtcgcggaccctgggcgaccggcccgtgttcgtggcggagaccgagagccacggccgccaggacgccctcctgcccggtgtcgacctgacccgcaccgtgggctggttcacctctgtccacccggtgcgcctgcggcccggagccggggccgaacggctgctgaaggagaccaaggagcggctgcgcaccgtgccggaggccggtctcggccacgacctgctccgcctcggcggcgcggcgtcctccccgcgggagagcggccgggaactgccccgcccgcagttcggattcaactacctcggccgggtcgccgtggccgaagccctcaccgacgagggcacggagcccgccggggcctgggcgttcgcgggccacagcctcaccgcgcaaccccccgaactgccgctcacacacgaggtggaactgaccgtcgtcctggaggacggcccgcggggaccggttctccgagcccgctggaacgcctccgcccgctgcctgaccggggcgcgcctgaccgcgctggcgcaggagtgggagaaggcgctgcacgagctgaccgccctggccggcgtcgccgggaccgccggcctgatcccctcggagaccggcgccggcgacctggaccaggacgcgatcgaggagtgcgaggcggcggcggacttcgaggtcgcggacctgctcgccctcgcgcccgcccaggagggcctgctcttccacagcaccttcgacgacgcggcggaggacgtgtacgtcggccagctggcgctggagttccacggcgagctgtcgggcgcacggatgcgggaggcggcccagcaggtcctcgaccggcacgacgtgctgcgcgcggccttcctccagcgccgctccggcgagtggagccaggcgatcgccgccaggacgccggtgccctgggaggagcacgacctgtccgccctggccggggaggagcgggagcggcggctggacgccctgctggccgggcaccgcacccgccggttcgacctcgcacggccgccgctggtgcgcttcctgctcgtcacgacggcggcggaccggcacgtgctggccgtgaccaaccaccacctggtactggacggctggtcgctgccgttggtggtgcgcgacctcatggccctgtacggcacggacggcgccgccctgcccgccgtacgcccgtaccgcgactacctcgcctggctcgccggccaggacgcggacgcggcccacgccgcctgggcacaggcgctcgccgggctccagccgtcactgatggccccggacgccccccgcgacggcgcggccccgctcgcgcaccaccgcaccatggaccccgacgtcgtctcccgcctcaccgcctggtcccgccgcctgggcgtcaccctcaactccgtggtggagaccgcgtgggccctcctcctgggccggctcaccggccgcgacgacgtcagtttcggcatcgccgcctccggccgccccaccgatctgcccggcgcgggggagatcgtcggcctgctgatgaacaccgtgccggtgcgcgtcaccctggaccccgccgaaccgctggaagcactcgtccggcgcgtgcaaagggaacaggccgccctcctcgaccaccagttcctccccctggcacaggtgcagcagagcctcggagcgggcgacctcttcgacaccacgctcgtcttcgagaactacccgctggcccccgccgacggcctcggcgacggcgacgggctccgcctgcagggggcgcgcggccacgacggcaaccactaccccctcagcgtcaccgtcggccccgcacccgacctccagctccgcttcatccaccgccccgacctgttcacacccccgtgggtggaggacctggcggcgcggttcgagcaggtgctcgacgccatggccacgtccggcgacaccccggccggccgactggacatcctgctgccgcgcgaacacgacacgctcctgggcgactgggcgcgcggtgaggcggcgagcgcacgggagtgccccgtcgccctgttcgaggaacaggtcgaccgcacccccgatgtcctcgccctggtcgagggcggtgacggcgcccggctgagctacgccgagttcgacgcccgcgccaaccgcatggcgcgcttcctcatcgcccgcgggctcggggccgaggacctggtcggcctggtcttcccccgcggcgccgacctgctcaccggtctgtggggggcgctcaaggccggtgcggcctacctgccggtggacgtggactacccggccgaacggatcgcgctgctcctcggcgacgggaaccccgccctcgtcctcaccacctccgcccacgcccacctggtgcccgaggcgccggggcggcagatcctctgcgtcgacctgcccggccccgcggacgaactcgcccgcgccgcggaaggaagggtgaccgacagcgagctgccgcgcccggtcgggcccgacaccctcgcctacgtcctctacacctccggctccaccggccgccccaagggcgtggcggtcggccggggttcgctggccgcgcacgccgtccgctcccgcgaccgctacccggacgcggccggggtgtcgctgctgcactcaccggtcgcgttcgacctgacggtgaccgccctgttcaccacactgatctccggcggcaccctcctcctcgcggaactggacgaacacgcccaggactccggcgtcacctacgtcaagggcacgccctcccacgtcgccctcctgaacgagctgcccggcgtcctcgacgccaccgcggagcgccccggcacgctcgtgctcggcggcgagccgctcaccggagagatgctggagcgctggcgcgcccaccacccgcaggcccgggtcttcaacgactacgggccgtcggagaccagcgtcaactgctccgacctgctcctcgaacccggagccgaggtaccggagggcctgctgccgatcggtcgcccgctgcccggcaaccacatgttcgtcctcgaccacctgctccagcccgtaccggtcggcgtcgtcggagagatctacgtctccggcgtcggcgtggcccgcggctaccacggccggcccggcctgaccgccgagcgcttcctgccctgcccctacgacgcaccgggcgcccggatgtaccgcaccggggacctggggcgctggcggcccgacgggatcatggagtgcctgggccgaaccgacgaccaggtcaaggtgcggggcttccgggtggagctgggcgaggtggaggccgcgctcgccgcccgctccgacgtcgcccgcgccaccgtcgtcgtgcgcgaggacgagccgggggacaggcggctgacgggctacgtggtccccgaagggggaccggacgcggacttcgacccggcggccgcgctgcgcgacctggcggccgccctgccgccgtacatggtcccggccgcgatcgtggtcctctccgaactgccgcgtaccgagaacggcaagctcgaccgcagggcgctgcccgcgcccgactacggcaccgcctccgtcggacgtgcgccgcgcaccgccctggagaccgacctgtgcgccctgttcgccgacgtgctcggcgtgcccggcatcaccctcgacgacgacttcttcgccctgggcggccactccctgctcgccgtccggctcgccggccgcatccgggccgagctcggactgcggctcgacatccggacgatcttcgaccaccgcacggtcgcggacctcctcgccgatccgaatcct

SEQ ID NO: 2 - protein, 723 aa, Streptomyces fradiae
LTVRAEHRKASTLPPGNPAVSSGDSASRREKRAAAGSSSSADPLAGPHLVAAISATAEADPGRKAVGLVRDPEREGEEALRSYAWLDDTARRIAVLLRAAGLETGARVLLLFPQSAEFAAAYAGCLYAGMVAVPAPLPTGTSHEAARVVGIAKDSEAGAVLTVSETEADVRQWAARTGLGALPLHCVDELPGDADPDTWREPEIRADTVAVLQYTSGSTGSPKGVVVTHGALADNVRSLLTGFDLGSGARLGGWLPMYHDMGLFGLLSPALFSGGAAVLMSGSAFLRRPSQWLRLIDRFGLVFSAAPDFAYDYCVRRVRPEETDGLDLSRWRWAANGSEPIRAETLRAFAKEFAPAGLHPNATTPCYGLAEATLLVSLPTGELRTRRVDVAELENHRFVEAAVGRPSREIVSCGRPPSLEIRVVDPATGKSVTGGDGAGETRVGEIRVRGASVARGYWQKPEATAETFVMDADGSGPWLRTGDLGALYEGELYVTGRIKELLIVHGRNIYPHDIEHELRARHAELGAVGAAFSLSTESGEVVVVTHEVNPTVRPEQGPELVTALRATLAREFGLAPAGVVLVRRGRIPRTSSGKVQRRLTARLFSTGELAQVHADPGAHRLLAELREAHDRGGAFPPPSPPASQDPEALRQRLRELCADCLGVPVDSLATDAPLTDYGMTSVTGTALCGMVEEYLDVECDLELLWQEPTIDGLASRLASRTVR

SEQ ID NO: 3 - DNA, 2172 bp, Streptomyces fradiae
ttgaccgtccgggcggagcaccggaaagcgtcgaccctgccgccggggaacccggccgtcagcagcggcgactccgcgtcccgccgggagaagagggccgccgctgggagcagttcttcggcggacccgctggccggcccccacctggtggccgcgatctccgcgacggccgaggccgacccggggcgcaaggccgtcggtctcgtccgggatccggagcgcgagggcgaggaggcgctgcggagctacgcctggctcgacgacaccgcccgccgcatcgccgtcctcctgcgtgcggccgggctggaaacgggcgcacgcgtgctgctgctcttcccgcagtccgcggagttcgcggcggcctacgccgggtgtctctacgcgggcatggttgccgtccccgcgccccttccgaccggcacctcccatgaggccgcacgcgtcgtcggcatcgcgaaggactccgaggcaggcgccgtcctcaccgtctccgaaaccgaggcggacgtccggcaatgggcggcccgcaccggcctgggcgcgctgcccctccactgcgtcgacgaactgcccggcgacgccgaccccgacacgtggcgggaaccggagatccgggccgacaccgtggcggtcctccagtacacctccggctccaccggcagccccaagggggtcgtcgtcacccacggcgcgctcgccgacaacgtgcgcagcctgctcacgggcttcgatctgggatccggcgcccggctgggcggctggctgccgatgtaccacgacatggggctgttcggcctgctgagcccggcactgttcagcggcggagccgccgtgctgatgagcggcagcgccttcctgcgccgcccgtcccagtggctgaggctgatcgaccgcttcggcctcgtcttctcggcggcgcccgacttcgcctacgactactgcgtacggcgggtgagacccgaggagacggacgggctcgacctgtcgcgctggcgctgggcggccaacggctccgagcccatccgcgccgagacgctgcgcgccttcgccaaggagttcgccccggccggactccacccgaacgccaccaccccttgctacggactggccgaggcgaccctgctggtgtccctgcccacgggtgagctgcgcacccgacgggtggacgtcgcggaactggagaaccaccgcttcgtcgaagcggccgtgggacgcccctcccgcgagatcgtgtcctgcggccggcccccgtccctggagatccgcgtcgtcgaccccgcgaccggcaagtccgtcacgggcggcgacggagccggcgagaccagggtgggcgagatcagagtgcgcggcgcgagcgtcgccaggggctactggcagaaaccggaggcgaccgccgagacgttcgtcatggacgcggacggctccgggccctggctgcgcaccggcgacctcggcgctctgtacgagggcgagctgtacgtcaccggccgtatcaaggaactcctcatcgtgcacggccgcaacatctacccccatgacatcgagcacgaactgcgcgcccgccacgccgaactcggcgctgtcggggccgccttctccctcagcaccgaatcgggcgaggttgtggtcgtcacccatgaggtgaaccccaccgtccggcccgagcagggtcccgagctggtgaccgccctgcgtgcgacgctcgcgcgggagttcggcctcgccccggccggggtggtgctggtgcgccgcggccgcatcccgcgcaccagcagcggcaaggtgcaacgccgcctgaccgcccggctgttcagcacgggggaactcgcccaggtccatgccgaccccggcgcccaccgcctcctggcggaactcagggaggcgcacgaccgcggcggcgccttcccgcccccctccccgcccgccagccaggaccccgaggccctgcggcagcggctgcgcgagctgtgcgccgactgtctcggcgtccccgtggactccctcgccacggacgcccccctcaccgactacgggatgacctccgtcaccggcaccgccctgtgcgggatggtggaggagtacctggacgtcgaatgcgacctggaactgctctggcaggagccgacgatcgacgggctcgcctcccggctggcctcgcgcaccgtgcgctga

SEQ ID NO: 4 - protein, 3700 aa, Streptomyces fradiae
VCARTPPRVRRCRPLQPESGRSMLESSAHRVAATSAQTGIWTAQRLRGDDRLYACGLFLELDHVVEEVLSEAIRRAVADTEALRTAFREDADGALEQHVLARPPSTQTRLFHADPSGGTPSRSASLDWMDRQRAQPWDLASGDTCRHTLIPLGGDRSLLHLRYHHLALDGYGAALYLDRLAAVYRALRTGHQPPPCAFAPLARLVEEDHAYRNSARHRADANHWRDRFADLPRPTSLADATTPAAPTTPATPAAPAAPDELRRTVRLSAARSAALRRASDRSGRPWPVYATAAVAAFLSRLAPGEEVVVGLPVTARVTPAAVRTPGMLANVVPLRLPVRQGMSTAELLELTAAEISTTLRHQRHRTEDIGRALGLHGAPPATTLVNVMAFAPVLDFGDCRAPVHQLSAGPVEDLVVNLLGTPGDGGESDGTELEITVAANPRLHSADAVASLAARLAEFLTHMGQDAEAPLGRTRLLDAEEEVAAVARGHSPRRDLRARTLPELFARQVARTPDAPAVSSDRATWTYAQLDAHAERVARRLAARGVGPESLVALAVPRGVELAALILGIQRAGGAYLPIDPEYPAERVGFLLRDARPALLVGGTGTEPSAADCPRVPAEELLDAGACRAEADVPPPGSLPVDLPAYVVHTSGSTGRPKGVVVTHAGIAALAAEQIERYRLGPGSRVAQLAALGFDVAVAELVMALASGSCLVLPPHGLAGDELASFLRDRRITTALAPAAVLATLPPGDLPDLTDLVTGGEQPPPALIARWAPGRRMFNVYGPTEATVQATSGRCAADGDRSPDIGNPEAGVDAYVLDAALRPVPDGVTGELYLRGRGLARGYLGRPGLTAGRFVADPHTGTGERMYRTGDLVRRVPGDGRTVLRFVGRADDQVKIRGFRVEPGEVEAALAELDGVEQALVTVREERPGDRRLVGYLTPAPGHRGSLDVERLRRVLADRLPAHLVPSLLMELAEIPRTANGKVDRAALPDPAPLAPTAGRAPRDAREEALCALFAEVLGVEEVGVDLDFFALGGDSLLAARLASRIRGRLGKAVTVREVFRSPTVARLAEELGDGAVPDDHVRPVRPRPERLPLSSAQRRLWFIDELNGASAAYNIPTVLHLEGPLDVPALHAALGDVTDRHETLRTTLRPPADDGSAGAPEQHIAPPGGHRPPLPVLDVAPEALAGELRAAAGHVFDLARDLPVRATLYRTGELEHALLLLVHHVAADGASMGPLIGDLATAYTARLAGRAPVLPPPEVTYADFALWERGSRERSAAQAEGIDYWRRALAGLPDHIRLPADRPRSQEPVRRGGIARFEVPPALYAGLVELAQGVGATPFMVLQTAIAVLLSRMGAGTDIPLGTPVAGRQDEALDGLVGCFVNTVVLRTDVSGDPTTTELLARTRDGDLEALAHQDVPFDRVVEAVNPVRSTSRHPLFQVMLILNGSDQDRHRARFPRLADRVETVEPGETKFDLSWHFTHRDGPDRSLEGALVHAADLFDDDTAHRLTARLLDVLTAMVDDPARPVGTIDVLSAAEHRLVRAWGTGTPRPPGSRPEPVAARIAGQAARTPDAPAVTEPGRVWSYAELDARADRVAAALAARGIGAEDLVAVLLPRGAELVATLLGILRAGAAYLPLDTGHPADRNRRALSDSAPALLVTDAGRSRTLRGETGCAALVLGAEDTERELADRAPLPRDGAGLVRPVTGDNAAYTILTSGSTGRPKAVVVTRDALDAFVDRALDTYGDALGGEALLHSPVAFDLTVVTLYGPLAAGGRVRVGDLDESGIARWEKERPAFVKATPSHLALLTEFGGSTAPGTVVLAGEQLIGARLDRWRTRLGASGTTVLNSYGPTETTVNCLEHRIAPDADVPSGPVPVGRPVPGVRVLLLDDRLRPVAPGVTGELYVCGPGVARGYRARPAATAERFVACPQGRPGERMYRTGDLMRWTADGELVYEGRADAQVKVRGFRVEPGEVEAALLGLPGVREAAVTLLEGPEGTEGPEGAPGRVAAPARLVGYVVGASEEPAALLERLRVRLPDHMVPAALVDLDALPLTPNGKLDRRALPAPDFGRHAGRRAPSGPEEEALCALFADVLGVPEVGADDSFFTLGGDSIVSIQLVGRARGAGLHLTVRDVFEHPTAAGLATVVRSAGPDADAERPAPQALAPSGTLPYVPAAARLVARTGSMRARGADRFHQSVVLTTPANAAADDVRRVLQTLIDHHGALRLRTAADRDGSPDGLVITEPGTVAAAGLLRCRDAAGLQGVALREAVEREAGHARDALDPSTGAVLRAAWLDRGKDRLGLLVLVAHHLSVDGVSWRILADDLRQAWTPADAPATTATLPPEGASLREWATRIARRATETAVTGRLPHWRATLAGLDDPDGDVVALETRLDPEADTHGTAREHAHGLSPDLTDALVRTAPAALRADTGELLLAAYALAASRTLGDRPVFVAETESHGRQDALLPGVDLTRTVGWFTSVHPVRLRPGAGAERLLKETKERLRTVPEAGLGHDLLRLGGAASSPRESGRELPRPQFGFNYLGRVAVAEALTDEGTEPAGAWAFAGHSLTAQPPELPLTHEVELTVVLEDGPRGPVLRARWNASARCLTGARLTALAQEWEKALHELTALAGVAGTAGLIPSETGAGDLDQDAIEECEAAADFEVADLLALAPAQEGLLFHSTFDDAAEDVYVGQLALEFHGELSGARMREAAQQVLDRHDVLRAAFLQRRSGEWSQAIAARTPVPWEEHDLSALAGEERERRLDALLAGHRTRRFDLARPPLVRFLLVTTAADRHVLAVTNHHLVLDGWSLPLVVRDLMALYGTDGAALPAVRPYRDYLAWLAGQDADAAHAAWAQALAGLQPSLMAPDAPRDGAAPLAHHRTMDPDVVSRLTAWSRRLGVTLNSVVETAWALLLGRLTGRDDVSFGIAASGRPTDLPGAGEIVGLLMNTVPVRVTLDPAEPLEALVRRVQREQAALLDHQFLPLAQVQQSLGAGDLFDTTLVFENYPLAPADGLGDGDGLRLQGARGHDGNHYPLSVTVGPAPDLQLRFIHRPDLFTPPWVEDLAARFEQVLDAMATSGDTPAGRLDILLPREHDTLLGDWARGEAASARECPVALFEEQVDRTPDVLALVEGGDGARLSYAEFDARANRMARFLIARGLGAEDLVGLVFPRGADLLTGLWGALKAGAAYLPVDVDYPAERIALLLGDGNPALVLTTSAHAHLVPEAPGRQILCVDLPGPADELARAAEGRVTDSELPRPVGPDTLAYVLYTSGSTGRPKGVAVGRGSLAAHAVRSRDRYPDAAGVSLLHSPVAFDLTVTALFTTLISGGTLLLAELDEHAQDSGVTYVKGTPSHVALLNELPGVLDATAERPGTLVLGGEPLTGEMLERWRAHHPQARVFNDYGPSETSVNCSDLLLEPGAEVPEGLLPIGRPLPGNHMFVLDHLLQPVPVGVVGEIYVSGVGVARGYHGRPGLTAERFLPCPYDAPGARMYRTGDLGRWRPDGIMECLGRTDDQVKVRGFRVELGEVEAALAARSDVARATVVVREDEPGDRRLTGYVVPEGGPDADFDPAAALRDLAAALPPYMVPAAIVVLSELPRTENGKLDRRALPAPDYGTASVGRAPRTALETDLCALFADVLGVPGITLDDDFFALGGHSLLAVRLAGRIRAELGLRLDIRTIFDHRTVADLLADPNP

SEQ ID NO: 5 - DNA, 11100 bp, Streptomyces fradiae
gtgtgcgcccggacacctccgcgcgtccggcggtgccgcccccttcagcccgagagcgggagaagcatgttggagtcctcggcacaccgtgtggccgccacgtcggcccagaccgggatctggacggcgcagcgtctgcgcggggacgacaggctctacgcctgcggcctcttcctcgaactcgaccacgtggtggaggaggtgctgagcgaggcgatccgccgcgccgtcgccgacaccgaggcgctgcgcaccgcgttccgggaggacgcggacggcgcgctggagcagcacgtcctcgcccggccgccgagcacgcagacccgcctcttccacgccgacccgagcggcggaaccccctcccgctccgcgtccctggactggatggaccggcaacgggcgcaaccctgggacctcgcgtcgggcgacacctgccgtcataccctgatccccctcggcggcgaccgctcgctgctgcacctgcgttaccaccacctcgccctggacgggtacggcgccgcgctctatctggaccggctcgcggcggtctaccgcgcgctgcgcaccggccatcaaccgcccccctgcgcgttcgcgccgctggcccgcctggtcgaggaggaccacgcctaccggaactccgcccgtcaccgcgcggacgccaatcactggcgcgaccgcttcgcggacctcccgcgccccaccagcctcgccgacgccaccacgcccgcggcgcccaccacgcccgccacgcccgccgcgcccgccgcgcccgacgaactgcggcgcaccgtgcgcctgtccgccgcccggtccgccgcgctgcgccgtgcctcggaccggagcggccgaccctggcccgtgtacgccacggccgcggtggccgccttcctgagccgactcgcgccgggggaggaggtcgtcgtcggcctcccggtcaccgccagggtgacccccgccgcggtgcgcacaccggggatgctcgccaacgtcgtaccgcttcgcctgcccgtccggcagggcatgtcgacggcggagctgctggagctgaccgcggccgagatcagcaccacactgcgccaccagcgccaccgcaccgaggacatcgggcgggcgctcggactccacggcgctccgccagccaccacactcgtgaacgtcatggcgttcgccccggtcctcgacttcggcgactgccgggccccggtgcaccagctctcggccggaccggtggaggacctggtcgtcaacctcctcggcaccccgggcgacggcggcgagagcgacggcaccgagctggagatcactgtcgccgccaacccccgcctccactcggcggacgcggtggcctcgctggccgcgcggctcgcggagttcctcacgcacatggggcaggacgccgaggcgcccctcggccggacccggctgctcgacgcggaggaggaggtcgcggcggtggcccgcgggcacagtccccgacgcgacctgcgcgcccggaccctgcccgagctcttcgcccggcaggtcgcccgcaccccggacgcccccgccgtctcctcggaccgcgccacctggacgtacgcccaactcgacgcccacgccgagagagtggcccggcggctcgccgcgcggggcgtgggaccggagagcctcgtcgccctcgcggtgccgcggggcgtcgagctggcggcgctgatcctcgggatccagcgggccggaggggcctacctccccatcgacccggagtacccggcggaacgcgtcggtttcctgctgcgcgacgcccgccccgccctgctcgtcggcgggacggggaccgagccctccgccgccgactgcccgcgcgtgccggccgaagagctcctcgacgccggggcgtgccgcgccgaggccgacgtgcccccgcccggaagcctcccggtggaccttccggcgtacgtcgtccacacctccggctcgaccgggcggcccaagggggtggtggtcacccacgcgggcatcgccgccctggcggccgagcagatcgaacgctaccgactgggacccggctccagggtggcgcagctggcggccctcgggttcgacgtcgcggtcgccgaactcgtgatggcgctggcgtcggggagctgtctcgtcctcccgccgcacggcctcgccggcgacgagctggcctccttcctgcgcgaccggcgtatcaccacggccctcgccccggccgccgtactggccaccctgccccccggcgacctccccgacctgaccgatctggtcaccggaggcgagcagccaccgcccgcgctgatcgcccgctgggcacccggccggcggatgttcaacgtctacgggccgacggaggccaccgtccaggccacctccgggcggtgcgcggccgacggcgaccggtcgccggacatcgggaaccccgaggccggagtggacgcctacgttctggacgccgcgctgcgacccgtgcccgacggggtgacgggcgagctctacctgcgtggcaggggcctggcccgcggctacctcggccgccccggcctcaccgccggccggttcgtcgccgacccccacaccgggacgggcgagcggatgtacaggaccggggacctggtgcgccgggtgcccggcgacggccgcaccgtgctgaggttcgtcggccgggccgacgaccaggtgaagatccggggcttccgggtcgagccgggcgaggtcgaggccgccctcgccgaactcgacggcgtcgagcaggccctggtgaccgtccgggaggagcggcccggcgaccgcaggctcgtcggctacctgacacccgcccccgggcaccggggatcactggacgtcgagcgcctgcgccgcgtgctcgccgaccggctccccgcccacctcgtcccctccctcctgatggagctggcggagatcccgcgcaccgccaacggcaaggtggaccgtgcggcgctgccggaccccgctcccctggccccgaccgccgggagggcgccgcgcgacgcccgagaagaggccctgtgcgcgctcttcgccgaggtgctgggcgtcgaggaggtcggcgtcgacctcgacttcttcgcgctgggcggtgactcgctgctggccgcccgactggcgagccgcatccgtggccggctgggcaaggcggtcaccgtacgggaggtcttccggtccccgaccgtcgcccgcctcgcggaggaactgggcgacggggccgtgccggacgaccacgtccgtcccgtccggccccgcccggagcggctgccgctgtcgtccgcgcagcgccggctgtggttcatcgacgaactcaacggcgcgtcggcggcctacaacatcccgaccgtcctccacctggagggaccgctcgacgtccccgcgctgcacgccgcgctcggcgacgtgacggaccggcacgaaacgctccgcaccaccctgcggccccccgcggacgacggctcggcgggcgcacccgagcagcacatcgcgccccccggcggccaccggccaccgctgccggtgctcgacgtcgctcccgaagcgctcgccggggagctgcgcgccgcagcgggccacgtcttcgacctcgcgcgggaccttccggtgcgcgccacgctctaccgcaccggcgagctggagcacgcgctgctgctgctggtccatcacgtcgccgccgacggcgcgtcgatgggccccctgatcggcgacctggccaccgcctacacggcccggctcgcgggacgcgcacccgtcctcccgccacccgaggtgacgtacgccgacttcgcgctgtgggagcgggggagccgggagcgctccgccgcgcaggccgaggggatcgactactggcgccgggccctggccgggctgccggaccacatccggctccccgccgaccgcccccgctcgcaggaaccggtccgccgcggcgggatcgcccggttcgaggtgccgcccgccctgtacgccgggctcgtggagctggcccaaggcgtcggcgccaccccgttcatggtgctccagaccgcgatagccgtcctgctcagccggatgggagccggaaccgacatccccctgggcacgccggtcgccggccgccaggacgaggcgctcgacggactcgtcggctgcttcgtcaacaccgtcgtcctgcgcaccgacgtctcgggtgaccccaccacgaccgaactgctggcccggacgcgcgacggcgacctggaagccctcgcccaccaggacgtgcccttcgaccgggtcgtggaggcggtcaaccccgtccgttccacctcacggcaccccctcttccaggtcatgctgatcctcaacggttctgatcaggaccggcaccgggcgcggttcccccgactggccgaccgggtcgagacggtggagccgggggagaccaagttcgacctctcctggcacttcacccaccgcgacgggccggacaggtcgctggagggggccctcgtccacgccgccgacctgttcgacgacgacaccgcgcaccggctcaccgcacgcctgctcgacgtcctgaccgccatggtcgacgaccccgcccggcccgtcgggaccatcgacgtcctcagcgccgccgagcaccgcctcgtgcgcgcgtgggggaccggcacgccccgcccccctggcagccgtccggagccggtcgccgcgaggatcgccggccaggccgcccgcacaccggacgcccccgcggtgaccgagcccggacgggtctggagctacgccgaactcgacgcccgcgccgaccgggtggcggcggccctggccgcacgcggaatcggcgccgaggacctcgtcgccgtactcctgccccgcggcgcggaactggtcgccaccctgctggggatcctccgggcaggcgccgcctacctcccgctcgacaccggacaccccgccgaccgcaaccgccgggccctctccgactccgccccggcactgctggtgaccgacgccgggcggtcgcgcacgctccgaggagagaccgggtgcgccgcgctggtcctgggtgcggaggacaccgagcgggaactggcggaccgcgcccccctcccgcgggacggcgccggcctcgtacgcccggtgaccggggacaacgccgcctacacgatcctcacctccggttcgacgggccgccccaaggccgtcgtcgtgacgcgggacgcgctggacgcgttcgtcgatcgcgccctggacacctacggcgacgcgctgggcggagaggctctgctgcactccccggtcgccttcgacctcacggtcgtcaccctgtacgggccgctggccgcgggcgggcgcgtccgggtcggcgacctcgacgagtccgggatcgcccggtgggagaaggagcgcccggccttcgtcaaggccacgccctcccacctcgcgctgctgacggagttcggcggctccacggcccccggaacggtcgtcctggcgggcgagcaactcatcggcgcacggctggaccgctggcggactcgcctgggcgcctccggcaccaccgtcctcaacagctacgggcccaccgagaccaccgtcaactgcctggagcacaggatcgccccggacgccgacgtgccctcgggacccgtgccggtgggccggccggtgcccggggtacgggtgctgctcctcgacgaccgcctgcgccccgtcgccccgggcgtcacgggcgaactgtatgtctgcgggcccggcgtcgcccgcggataccgtgccaggccggccgccaccgccgaacggttcgtcgcctgtccgcaaggacggccgggagagcggatgtaccgcaccggcgacctgatgcgctggaccgccgacggcgaactggtctacgagggacgggccgacgcccaggtgaaggtgcgcggcttccgggtcgagcccggcgaggtggaggccgcgctgctcggcctccccggcgtccgcgaggccgccgtcaccctcctggaagggccggaaggaacggaagggccggaaggggcgcccgggagggtggccgcccccgcccgcctcgtcggctacgtcgtcggcgccagcgaggaaccggccgccctcctcgaacggctgcgcgtcaggttgcccgaccacatggtgcccgccgccctcgtggacctcgacgccctgccgctcaccccgaacggcaagctcgaccgccgcgccctgcccgcccccgacttcggccgccacgcgggccgccgcgcacccagcgggccggaggaggaagcgctctgcgcgctcttcgccgacgtgctgggagtgcccgaggtcggcgcggacgacagcttcttcacgctcgggggcgacagcatcgtcagcatccagctcgtcggccgcgcccggggagccggactgcacctcacggtgcgcgacgtcttcgagcaccccacggccgccgggctggcgaccgtcgtccggtccgccggaccggacgcggacgcggagcgtcccgcgccgcaggcgctcgccccgagcgggacgctgccctacgtcccggccgcggcgcggctcgtggccagaaccggctcgatgcgcgcccgcggcgccgaccgcttccaccagtcggtggtcctcaccaccccggcgaacgcggcggccgacgacgtccggcgcgtgctccagacgctgatcgaccatcacggggcactccgcctgcggaccgccgccgaccgggacggatcgccggacggcctggtgatcaccgaaccggggacggtcgccgccgccggcctgctgcgctgccgcgacgccgccggactccagggcgtggctctgcgggaggcggtggagcgggaggccgggcacgcacgcgacgccctcgacccgagcaccggggccgtgctgcgcgcggcctggctggaccgggggaaggaccggctcggcctgctggtcctggtggcccaccacctcagcgtggacggcgtctcctggcgcatcctggcggacgacctccgccaggcatggaccccggccgacgcccccgccacgacggcgaccctgccgccggagggcgcttccctgcgggagtgggccacccggatcgcccggcgcgccaccgagaccgccgtgaccggccggcttccccactggcgcgcgaccctggccggcctcgacgacccggacggcgacgtggtcgccctggagacccggctcgaccccgaggccgacacccacggcacggcgcgcgagcacgcgcacggcctgtcacccgacctgaccgacgcgctcgtgcgcaccgcgcccgcggcgctgcgcgcggacaccggcgaactgctgctggccgcctacgcgctcgccgcgtcgcggaccctgggcgaccggcccgtgttcgtggcggagaccgagagccacggccgccaggacgccctcctgcccggtgtcgacctgacccgcaccgtgggctggttcacctctgtccacccggtgcgcctgcggcccggagccggggccgaacggctgctgaaggagaccaaggagcggctgcgcaccgtgccggaggccggtctcggccacgacctgctccgcctcggcggcgcggcgtcctccccgcgggagagcggccgggaactgccccgcccgcagttcggattcaactacctcggccgggtcgccgtggccgaagccctcaccgacgagggcacggagcccgccggggcctgggcgttcgcgggccacagcctcaccgcgcaaccccccgaactgccgctcacacacgaggtggaactgaccgtcgtcctggaggacggcccgcggggaccggttctccgagcccgctggaacgcctccgcccgctgcctgaccggggcgcgcctgaccgcgctggcgcaggagtgggagaaggcgctgcacgagctgaccgccctggccggcgtcgccgggaccgccggcctgatcccctcggagaccggcgccggcgacctggaccaggacgcgatcgaggagtgcgaggcggcggcggacttcgaggtcgcggacctgctcgccctcgcgcccgcccaggagggcctgctcttccacagcaccttcgacgacgcggcggaggacgtgtacgtcggccagctggcgctggagttccacggcgagctgtcgggcgcacggatgcgggaggcggcccagcaggtcctcgaccggcacgacgtgctgcgcgcggccttcctccagcgccgctccggcgagtggagccaggcgatcgccgccaggacgccggtgccctgggaggagcacgacctgtccgccctggccggggaggagcgggagcggcggctggacgccctgctggccgggcaccgcacccgccggttcgacctcgcacggccgccgctggtgcgcttcctgctcgtcacgacggcggcggaccggcacgtgctggccgtgaccaaccaccacctggtactggacggctggtcgctgccgttggtggtgcgcgacctcatggccctgtacggcacggacggcgccgccctgcccgccgtacgcccgtaccgcgactacctcgcctggctcgccggccaggacgcggacgcggcccacgccgcctgggcacaggcgctcgccgggctccagccgtcactgatggccccggacgccccccgcgacggcgcggccccgctcgcgcaccaccgcaccatggaccccgacgtcgtctcccgcctcaccgcctggtcccgccgcctgggcgtcaccctcaactccgtggtggagaccgcgtgggccctcctcctgggccggctcaccggccgcgacgacgtcagtttcggcatcgccgcctccggccgccccaccgatctgcccggcgcgggggagatcgtcggcctgctgatgaacaccgtgccggtgcgcgtcaccctggaccccgccgaaccgctggaagcactcgtccggcgcgtgcaaagggaacaggccgccctcctcgaccaccagttcctccccctggcacaggtgcagcagagcctcggagcgggcgacctcttcgacaccacgctcgtcttcgagaactacccgctggcccccgccgacggcctcggcgacggcgacgggctccgcctgcagggggcgcgcggccacgacggcaaccactaccccctcagcgtcaccgtcggccccgcacccgacctccagctccgcttcatccaccgccccgacctgttcacacccccgtgggtggaggacctggcggcgcggttcgagcaggtgctcgacgccatggccacgtccggcgacaccccggccggccgactggacatcctgctgccgcgcgaacacgacacgctcctgggcgactgggcgcgcggtgaggcggcgagcgcacgggagtgccccgtcgccctgttcgaggaacaggtcgaccgcacccccgatgtcctcgccctggtcgagggcggtgacggcgcccggctgagctacgccgagttcgacgcccgcgccaaccgcatggcgcgcttcctcatcgcccgcgggctcggggccgaggacctggtcggcctggtcttcccccgcggcgccgacctgctcaccggtctgtggggggcgctcaaggccggtgcggcctacctgccggtggacgtggactacccggccgaacggatcgcgctgctcctcggcgacgggaaccccgccctcgtcctcaccacctccgcccacgcccacctggtgcccgaggcgccggggcggcagatcctctgcgtcgacctgcccggccccgcggacgaactcgcccgcgccgcggaaggaagggtgaccgacagcgagctgccgcgcccggtcgggcccgacaccctcgcctacgtcctctacacctccggctccaccggccgccccaagggcgtggcggtcggccggggttcgctggccgcgcacgccgtccgctcccgcgaccgctacccggacgcggccggggtgtcgctgctgcactcaccggtcgcgttcgacctgacggtgaccgccctgttcaccacactgatctccggcggcaccctcctcctcgcggaactggacgaacacgcccaggactccggcgtcacctacgtcaagggcacgccctcccacgtcgccctcctgaacgagctgcccggcgtcctcgacgccaccgcggagcgccccggcacgctcgtgctcggcggcgagccgctcaccggagagatgctggagcgctggcgcgcccaccacccgcaggcccgggtcttcaacgactacgggccgtcggagaccagcgtcaactgctccgacctgctcctcgaacccggagccgaggtaccggagggcctgctgccgatcggtcgcccgctgcccggcaaccacatgttcgtcctcgaccacctgctccagcccgtaccggtcggcgtcgtcggagagatctacgtctccggcgtcggcgtggcccgcggctaccacggccggcccggcctgaccgccgagcgcttcctgccctgcccctacgacgcaccgggcgcccggatgtaccgcaccggggacctggggcgctggcggcccgacgggatcatggagtgcctgggccgaaccgacgaccaggtcaaggtgcggggcttccgggtggagctgggcgaggtggaggccgcgctcgccgcccgctccgacgtcgcccgcgccaccgtcgtcgtgcgcgaggacgagccgggggacaggcggctgacgggctacgtggtccccgaagggggaccggacgcggacttcgacccggcggccgcgctgcgcgacctggcggccgccctgccgccgtacatggtcccggccgcgatcgtggtcctctccgaactgccgcgtaccgagaacggcaagctcgaccgcagggcgctgcccgcgcccgactacggcaccgcctccgtcggacgtgcgccgcgcaccgccctggagaccgacctgtgcgccctgttcgccgacgtgctcggcgtgcccggcatcaccctcgacgacgacttcttcgccctgggcggccactccctgctcgccgtccggctcgccggccgcatccgggccgagctcggactgcggctcgacatccggacgatcttcgaccaccgcacggtcgcggacctcctcgccgatccgaatcct

SEQ ID NO: 6 - DNA, 37360 bp, Streptomyces fradiae
gcccagggtcccggcgcggcccgcggcgacccccgacccgcgggcgctgcccgagcggctgcccctgtcgcccgcccagcgcaggctgtggttcctcaaccgctacgacagggaggccggcggctaccacatcagcgtcgcgctgcggctcaccggcgatctcgacgtcgacgccctccacgcggcactgggcgacctgaccgcccggcacgagagcctgcgcaccgtcttccgcgaggacgaacaggggccgcaccaggtcgtcctggacccgggggccccgcccgcacccgccgtcgtcccggctgccgcccaccgcatcgacgccctggtgcgcgaagccgtccgccgccccttcgacctggccgacgacatcccgctgcgccacaccctcttcacgctcccggacggcgaacacgtcctgctcctggtcatccaccacatcgccgccgacggctggtcgatggggccgctggcacgggacctggccgccgcctaccgcgcccgcgccgccggccgcgcgcccgactggcccgccccggccgcccgccccgccgcacacccgcccggacagcacggcgacgacgtggacgacacggtggaccgccgcctcgcccactgggccgaggaactgcgcggactgcccgacgaactcgcgctgccctacgaccggccgcgccccacgacaccccccggctacgccgagcgggtccccttccgcgtcgacgccgcgctgtaccgggacgtgcgggcgctggcggcccgccaccgggccaccccgttcatggtcctccacgccgccctggccgccctgtggcaccggctcggcgccggccccgacatccccgtgggcaccccgtccgccggccgcgaccggcccgagaccgccgacctcgtcggcttcctggtcaacaccctggtcctgcgcaccgacacctcgggcgacccggccttcgccgaactgctcgaccgggtgcgcgagaccgacctgcgggcctacgcccaccaggacgtgcccttcgagcggctggtggaggcggtcaaccccgcccgctcgcccagcaggcacccgctcgtccagacgatgctcaccttcgacaacgccgcccacggagcgctcgatcacctcctggacctgccgggcgtgcgcgcggaactgctgccgaccgccgagggcaccgcccacaccgacatcgaactgaccttcaccgagaccacggcggacaccgacggcgacggactcgacgcgtccctgcgctaccgccccgacctgttcgaccgcacgaccgcgcgggctctggcggagcggttcatggcgctgctccgcaccgtgacgcgcgagcccgccctgcggctcgggcagctcgacgtcaccaccgccggggaacgccggcggctggccgacgcggacgccgcggcacgggcgaggacggccgccaccgccgtcgccgtcctgcccgccctcttcgccgcctccgcccatcgcacgcccgccgcccccgccctcaccgacggcccggcgaccctggactacgcggaactcgacgcccgctccaaccgtctcgcccgggccctgctcggactcggcgtggggccggaggacttcgtcgccctggcggtgccccgctcggcggacctggtggtggccgtcctcgcggtgctgaagtcgggcgccgcctacctcgccgtcgaccccgaccacccggccgagcgcacctcgtacatcctccacgactgccggcccgtcgccgtcctctccacgaccgccgtccgcgagaccctgcacggcacggtgggcgaggcggtcggcgaggtcccgtggctgctgctcgacgagcccgccaccggcggcgcgacggccggccactcggccgcaccggtcaccgacgccgaccgccggtcgcccctgctccccgaccacccggcctacaccatctacacctccggctcgaccggacggcccaagggcgtcgtcgtcagtcacgccaacgtctcacgactgctgaccgcctgccgcgcggccgtggacttcgggcccgacgacgtctggacgctcttccactccagcgccttcgacttctcggtgtgggagatgtgggggccgctggcgcacggcggccggctggtcgtcgtcccgcacgacgtggccagatcacccggcgacctcctggacctgctgggccgcgagcgcgtcacggtgctcagccagacgccctccgccttcctccagctcctgcgggcggagtccgacctcggcgtccccccgaggaccaccgcggcgctgcggtacgtcgtcttcggcggagaagcgctggacaccgcccaactcgccccctggcggggccgcccggtccgcctggtcaacatgtacgggatcaccgagacgaccgtccacgtcacccacctggagctggacgacgccgccgtggaccgcggcggcagcccgatcggcacacccctgaacgacctgcgcgcccacgtgctcgaccaggggctgcttcccgtgccggtgggcgtcgtgggcgagctgtacgtcgccggccccggcctggcccgcggctaccgccgccgccccggcctgagcgccacccgcttcgtcgccgacccgttcgacaccggcggccggatgtaccggaccggcgacctcgtccggcgcacccaggacggcggcctccactacgtcggccggtccgactcccaggtgaaactgcgcggctaccgcatcgagcccggcgagatcgaggccgccgcccgccgccacccggacgtcgcccaggcggccaccgccgtgcacggcgaaggaccgcaggaccggtacctggtctgctacgtggtgccggcggccgacaccgaccccgacccgcaccaggtgcgcgcccacctggccgacgccctgcccggctatatggtccccgccgccgtggtgccgctgaccgccctgccgctgacccccaacggcaagctggaccgagcggcgctgcccgcccccgaccgggcggcgtgggccaccggcggcgccccgaccggaccgcgcgaggaagcgctctgcgccgccttcgccgacgtcctcggcgtccaggaggtcagccgcgacgccgacttcttcgccctgggaggccattccctctcggcggtccggctcatcagccggatcaggtcggcgctcggagtggagatcggcatccgcacgctcttcgaggcgcccacgcccgccgcgctgtcccggcgcctcgacaccgccgggaccggacggccccgcctcctgccgcgccgccgaccggaccgcgtcccgctctcctccgcccagcgcaggctgtggttcctcggagaactggaaggaccgagcgccacctacaacatcccgctcgccctgcgcctgcgcggccgtctcgacgtcgacgccctgcgcaccgccctggccgacgtggtgggccggcacgaggccctgcgcaccgtcttcccgtccgaggacggcgccccctaccagcaggtggtcgcggccgaacgggccgcgcccgccctcgacgtcgtggacgtcaccgagaaggagctgcccgccgccctcgccgaggcccgcgcacacgccttcaccctcaccgaggaccttccgctgcgggccgtactgctgcggaccggccccgccgaccacgtgctctccctcgtcctccaccacatcgcgggcgacggctggtcgctggccccgctcgcccgcgacctcagcaccgcctacgccgcacgtcgggagggccgcgccccgcagtggcggcccctgccggtgcagtacgccgaccacaccctctggaaagaggagttgctcggcgcggcggacgaccccgagagcctcctcgcccgccaactcgccttctggcgcgaggcgctggagggcgcgccggaacagatcgagctacccaccgaccggccgcgccccgccatggagagccaccgcggcgcgatccaccgcttcaccctccccgcgtcactgcgcgaccggctgcgtgacctcgcgcacgcgcggcgggccaccctcttcatggccctccaggccggactcgccgcactgttcgccaccctgggggccggccgggacatcgtcctcggcacgcctgtcgccggccgcgccgacgaggcggccgacgacctcgtcggcttcttcgtcaacaccctggcgctccgcaccgacctcggcggcgaccccaccttcgaggaactgctcgaccgcgtcagggaagccgacctgtccgccttcgcccaccaggacatcccgttcgagcaactggtggaggcgctcaaccccacccgctccctctccaggcaccccgtcttccaggtgctgctggccctccagaacaacgagcgcggcgaggccgtcatgccgggcctggaggtcaccgtcgaacgccccgcccaggcggcggccaagtacgacctcttcgtcaacctcgtggagtcccggaacgaggaggacggaacgaccgccgtcgagggagcggtcgagtacgccaccgacctcttcgacgcccgtaccgtcgcccggctcaccgagcgctaccacgacctgctcctggccgccgtcgaggagcccacgacacggctcagccggatgcccatgctcgacacggcggaacgcgacagactcacggccgaatggggcgccgccgccgcgggcccggccgaggacctggtcgccctcttccgtgcccgcgccgccgagacacccggcgcggtggcggtccgcggcgccggggacagcctcacctacgcccagctcgacgagcgggccggacggatcgcggcggccctcgcccggcacggcgccggccccgagagcagggtcgcggtgtgtctgccgcgcaccgccgacctggtggccgcgctgctcggcgtcctacgggccggcgccgcctacgtaccgctcgacccggagtacccggacgagcgcgtcgccgcgatcctggccgacacccgcccggtggcgctgctcaccacggcggactgccgccccgcgatcaccggggccgcgaccgccgccggcggagccgtcctcctcgcggccgacgccgcacacggcgcgggccccgtgcccgagccccccgccccgctgcccgaccaggccgcgtacgtcctgcacacctcgggctccaccggacgccccaagggcgtcgtcgtcagccggggcaacctcgccaacctcctggccgacatgcgggaccggctgcgccccaccgccgacgaccggctggtcgccgtcaccacggtcagcttcgacatcgccgcgctggaactcttcctcccgctggtcaccggcgccggactggtcctggccgaccgcggcgccgcacgggcccccgaggaactggccgccctgctcaccgcgagcggtgccaccctcctccaggccaccccgaccacctggcagttgctggccgagaccgcccccgacgccctgcgcgggctgcgcaagctggtcggcggcgaagccctccccgcctccctggcctcccgactgcgcgagctgggcggcgaactcgtcaacgtctacgggcccaccgagaccaccatctggtcgaccgccgcccacctcgaccgggtcaccggcagcgccccgcccatcggccgggcgctgcgcggcacccgcgcctacgtgctggacgagtggctgaacccgcgccccgagaacgtccccggcgagctgtacctggccggcgccggcgtggcccgcggctacctgggacgcggtggcctgaccgcggagcgcttcaccgccgaccccttcggcgcgcccggcagccgcatgtaccgcacgggcgacctggtccgccgccgcgcggacggggagctggaattcctcggacgcaccgaccaccaggtcaaggtccggggcttccgcatcgaactgggcgagatcgagacggcactcggcgcgcacccgcacgtcgccggggcggtcgtggtcgcccgcgcggcgtccggcgcggccctcgtgccggacgcgccggccccacggcgactggtggcctacgtggtccccgagccccaccgcgccgcccccgacgacggccgggagcagaaccggctcgacgagtggcgggaggcctacgacaccctctacggcagctccgcacccgcccccctcggccaggacttcggcatctggcgcagcagtcacgacgggcagcccatccccctggacgagatgcaccagtggcgggcggccacggtggaccgcatccgggcgctgcggcccacgcgggtgctggagatcggagtcggcaccgggctgctgctctcggagctggcggaggactgcaccgcctaccacggcaccgacctgtccgcgcgggcgatcgagacgctgcgcgcacaggtcgacgccgaacccgcgctgaaggagagggtcgagctgcacgtccgcccggcccacgacttcgacggcctgcgccggggcttctacgacaccatcgtgctcaactccgtcgtccagtacttccccgacgccgaccacctcacccgcgtactgcgcggcgcgctcgacctgctcgcccccggcgggcggctcttcgtcggcgacgtccgcagcctggcactgctgcgcgccttccgcgcctcggtggagaccggcaacagcgcggtctccgaaactcccgccgccgtacttgccgccgccgaccgcaggacggccgcggagaacgaactcgtcatcgcccccgactacttcgcgcggctgcggcgggaggcccgcgaaccgctcctgctggacgtgcgcatccggcgcggacggccgtacaacgagctgacgcgctaccgctacgacgtcctgctggtcaaacaggagaccggagccgcgccctccgccctgcccccggccaccgaactgcgctggacgccggagaccggcgatgccgggcggctggccgagatctgcgcggcgcaccccggcgcgctgcgcgtcaccgcgatccccaacgcccgcgtgcggcgcgagaccaccgccctcgccgccctggaggacgggcgaccggtcaccgaggtgcgccggctgctggagcaacccggtgacggagtcgatccggaggacctgtacgacgccgcgaccgccgccggacgcaccgcctgggtgacctggtcggccgacggaccgccggacaccgtggacctcgtgctggccccggcgggcggggacggcgtgccgccggtggcgccgccggccgagctgtggcccggcgcgccggccgctgaccggccggagacgaacgacccgaccgccgggtcgcaccaccgcgaactggccgcccggctccgctcccacctggccgaacggctgccggactacatggtcccctcggccgtcgtcgtcctcgacgccctcccgctgaccgccaacgggaaggtggaccgcaacgcgctgcccgaccccgacccggcgggcacggacgccggccgcccgccgcgcacgccccgggaggaactgctctgcacgctcttcgccgacctgctgggcctgggccgggtcggagtccaggacagcttcttcggcctcggcggcgacagcgtcctgtccgtccgcctcgtcagccgcgcccgcgcacacgggctgccgctgaccacccgcgacgtcttcgagcaccacaccgccgccgcgctggcggcggccctggacggcagggaaccggagagcgaaccggacggcggcccgccgggccccgacgccaccgcggcgcggcccatcaccctcgacgaactcgccgagctcgaggccgagttcggcacggactgggaggagacacagtgaacggtccgcagcgcatggtcgaggaggtcctggcggtcaccccgctccaggaggggctgctcttccacgccgtcttcgacgagaacgtccccgacgcctacgtcagccggctggtcctggccctttccggagagctggacgccgaccggctgcgacaggccgcccaggcgctggtggcacgccacccggcgctgcgctcggccttccgccagcggcgctcgggggagtggttccaactggtcgccacccgccccgcggtgccctggcaggagctcgacctgcggccgtcggggagcccggcggaggcggacaagcacctggaggcgctgctggacgagcaccaccgcaccgggttcgacctcggccggccgcccctgctgcgcttcctgctggccaggaccggcgacgaccaccaccggttggccgtgacctatcaccacctcgtcctcgacggctggtccatgcccatcctgatgcgggaactggccgtgctgtacggcagcggcggcgacccgtccgccctcccgcccgtccgcccgcaccgcgaccacctcgactggctggcccgccgcccgtccgagcggagcgcccgcgcctggcggcaggcgctggcgggactgcccggccccacgctgatcgccccggacgccgaccgcaacgggccgctccccgggtcggtgtggacccggctcggcgagcgggacacccatgccctcggggcgtgggcgcgggcccgcggcgtgacggtgaactcggcggtgcaggccgcctgggccaccgtgatcggccgcctcaccggccgcgacgacgtcgtcttcggcacgacggtctcggggcggccgccggatctgcccggcagcgaggacatggtcgggttcttcatcaacaccgtgccgacgcgcgtgcggatgaggccggccgagccgatcggcgacctcgtcgtgcggatccagcgcgagcagaccgccctcatggagcaccagcacgtccggctctccgacatccagcgctggtccgaccggaccgtgctcttcgacacctccaccgcgttcgaaaactaccccgccgacgacctgtccgccgtcagctccgccgggcacgcgggactgcgtatcgagggaggctccggccgcaccaccaaccacttcccgctctccctctacgcgctccccggcccggcgctccgcctgcgcctggaccaccgccccgacgccgtggacgacgtcaccacacgccacgcggcggatctgctggaacgtgctctgaccgccgtccacagcgccccggccaccccgaccgccgcgctcgccgccacccccgcgacggcacgcgcggccgcaccccgcgccgccgggccgggcgccccggccacgatcgtggacgcgttcgaggcgcgtgtgcgggcgacccccgaggcccccgccgtcctcgccggcggcgaggagctgacctacgccgaactcgacgcccgggcgaaccggctggcgcgcctgctgctggagcgaggggtcggacccgagagccgggtcgccctcaccgtctcccggaacgcctggctgcccgtcgccgtgctcggcatcctcaaggcgggcggctgctacgtccccgtgggcgccacgctgccgcgggagcgcgccgcccgcatcctccgcgagaccgcaccggtctgtctgctcaccgaccccgacgccgaggccgcccggacccgccgcaccgcccccacgggagacgaccgggacgagaacgcgccgggcggcgtcgagcgcgtcgtgctgaccggcgccctcctggccgcgttcgacccggccccgccgaccgacgccgaacgggccggacccctgctccccggccatctcgcctacctcctccacacctccggctccagcggccggcccaaaggggtcgccgtcgaacacgcccaggtgaccgccctgctgtcctgggccggcaccggcgtcggagccgaccgtctgcaccggaccgtggcctccacctcggagagcttcgacgtgtcggtcttcgacaccctcgtcccgctgctcaccggcggccgcatcgagatcgtggagaacaccctggccgtcgccgaccggaccggcggcgaaccctccctcctgaacgccgtcccctcggccctgcaggcgctgctggagcgcggcgagccgctcgccgtccacaccttcctctgcgccggcgaacccttccccgccccactggcccgcagcctgcgcgccgccttcccgcgggcgcgcgtggccaacctctacggaccgaccgagacgaccgtcttcgtcaccgcccacttcctggacggaaccgacgacggcgcgccccccgtcggccgcccgctgcccggtgtgcgcgtccatatcctcgacccctggctccgtcccgtgccggacggcgtcgtcggggagctgtacctcgccggggaacacgtcacccgcggctactggcagcgcccggcgacgacggccgaacgctacgtcgccgacatcttcggcgcgcccggcgcccgcatgtaccgcagcggcgacctcggacggctccgccccgacggggagatcgacctggtcggccgggcggacgaccaggtaaaggtgcgcggccaccgggtcgagctgggagaggtggaggccgccctggcctcccacccggacgtcctgcgggccgcagccgccgtgcacgacggcaaacccgccggaccgcgcctggtgggctacgtcgtgccccgcgggccggcgcccgacaccgccgccgtcctggaccacgtgcgccgcgaggtgcccccttacatggtgccctcggcgctcgtggtgctggacgagctgccgctgaccgtcaacggcaagcgggaccgcgccgcactgccgcccccgcccgaccggagcgacaccacgcgggcgcgcgccccccgaggcccgcacgagacgatcctgctcggactgttcgccgaggtgctcggggtacgcccggtcggcatcgacgacgacttcttcgccctgggcggccactcgctgctcgccacccgcctggtcagccgggtgcgcaccaccctcggagccgaactggcggtgcgggacctcttcgaacaccccacggtggccggtctgtacgccaggatcgcccgcgccggggcggcccggccgccggtctcccgcgtccacgcgcggcccgaccgcgtccccctctcgttcgcccagcggcggttgtggttcctccaccgcctccagggccacagcgccgcctaccacgtcccgctcgcgctccgcctcaccggacgcctcgacccggccgcgctgcgcggcgcgatcgccgacacggtcgcccggcacggaagcctgcgcaccgtcttccacgaggacgccgagggcgtccgccagatcgtccaggacgcctcggccgccgcccggctgatcaccctgatcccggagcccgtcgaggacccgctgcgggcggcggaggaggcggtggcagaacccttcgacctgacggccggaccgcccctgcggtgcaggctgttcacccggtccgcggacccggcggacccgcgcgcgggcgccggccaggagccgcaagaacacctgttcctcctggtggtgcaccacatcgcggccgacggctggtcgctgcggatcatcgcccgggacgtggccgccgcgtacgccgcccgcgtgcgcggtgaggacttcgcgcccgccccgccccccgtcgactacgtcgaccacaccctctggcagcaccgggtgctcggcgaccccgacgcggacggcggccccgacacggagggcggccacgccacggagggcggcccgctcgacacccagctcgcgcactggcggcggcggctggccggcctgccgcaggagatcgcgctgccggccgaccggcagcgcccggccgcctcctcccaccggggcgcggacgtggacttcaccgtccccgccgccgcggccgaacggatcaggcaactggcgggaaccaccggcaccacgcccttcatggtcctccaggccgcactggcggtcctgctgcaccgcatgggggcggggaccgacatcccgctgggcaccccggtcgccgggcgcaccgacagcgcggtcgagggagtcgtcggactcttcgtcaacaccctggtcctgcgcaccgacctgagcggctcgcccaccttcgcccagctcctgggccgggtccgggccaccgccctggacgcctacgcccaccaggacgtgccgttcgaacggctggtcgaggtgctcgcccccgagcgctccctggcccgccaccccctcttccaggtctccctcgtcctgcagaacctcgacgaggcggcggcgccggtggacggactgcccgggctgcgcgccgaaacggtccgcacccggcgcgacggcgcgaaggtcgacctgtccttcgtgctggctcccggcggaccggaaggcggggacatgcccggagtcctcacctacagcgccgacctcttcgaccacgcgaccgcgagagggctcgtggaccggctgctgcgggtgctggaccaggtgctcgccgcccccgccacgcctgtggggcgggtggacgtgctcctgcccggcgaggcgcggcgcgagctggagcacagccgcggaccgggcgcggcgggagacggggacgaaccgctggcacgcttcgagaagtgggcggcgaccacccccgacgcccccgccctgcggtgggacggcggccgtctgacctacgccgagctggaccggaaggcggacgcggtggcccgcgcgctcgtcgggcgctccctcgggcccgaggacgtggtcgcggtcgtcgctccgcgcgacccggacgtggtggccgcactcctcggggtgctcaggtgcggcgccgcgtacctcccgatcgacgaggcatggccgcccgcacggatccggcggacgaccaccgacgccggcgcgcgcctgctcctggcgccgggcgacaccgacgccgcccggaccgccttcggccccgcctgcggcccggacaccgacatcctcggcctcgaggacccggccttccgggccaccggcggtccggcccttccggccgggcggaaccacccgcgctcgctggcgtacgtcctctatacctccggctccaccgggcgccccaagggcgtgggcgtggagcgccgggcactcgcgcactacgtggaaggggcagtccaccgctacccggacgcggcggcgacgaccctgctccactccccgctgaccttcgacctcagcgccaccgccctgttcacccccctcgcctcgggcggctgcgtcgtcctgggcgaggtggaccgtgcggcggaggcccacccggtggacttcgtcaaggcgaccccgtcccacctgcccctgctggaacggcgtcccggactgctcggggagaacggcaccctcgtcctgggcggggaagccctcgacgggcgggccctgcgcgcctggcgggccgcccacccgcacgccgaggtcgtcaacgcctacggccccacggagctgaccgtcaactgcgccgagcaccgcatcgccgccggcgaaccggtgccggacgggccggtaccgatcggccgcccgttcgccggcgtccgcgcgatggtgctcgacacggcacttgcccccgcacccccgggcgtggccggggagctgtacgtcacggggcccggagtggcccgcggctacctggggcagcgcgccctgaccgccgagcggttcgtggcctgcccgttcggggagccgggggagcggatgtaccgcaccggcgacctcgtccgccgccttcccggcggcgaactggagtacgtgggccgaacggacgagcaggtgaagctgcggggcttccggatagaactgcccgaggtggcgcgcaccctggccgccgacgagtcggtcgcgcgcgcggtcgtcgtcgtacgggaggaccgtccgggcgaccggcggctgaccggctacgtggtcccggcggcgggagtccgcccgcacgaggacgaactgcgcggcgcggtggcccgcacgctgcccgactacatggtgccctccgccgtcgtcgtcctcgacgaactgcccaccacgccccacggaaaactcgaccggcgcgcgctccccgccccggcacaccgctcgcggggcggccgcccgccgcgcgaccagcgcgagcgggacctgtgccggatctacgccgacgtgctgggcctgcccgaggtgggcgccgaggacgacttcttcgccctcggcggccactccctgctcgccacccggctggtcaaccggatccgggccgaactcgccgaagaactcgacgtacggaccgtgttcgaggcccgaacggtcgccgcgctggcggcccggctgcggaccgcccgccctgacacccgccccgcgttgcgacggatgtcgcggtcggaggacttgtgatgcttcccctctccctcgcccagcagcggctgtggttcctccacacgatggacggccccagctccacctacaacatccccacggcgttgcggatgaccggcccgctggacgtcaccgcgctgggcgaggccctgcgcgacgtcgtacggcgccacgagacgcttcgcaccgtcttccccgacaccggcgacggcgcccggcagcacgtcctgcccgccgacgggaccgccgtcgagctggccgtcacccgttccaccgagcacgaactgcccgccgcgctggcccacgaggccggccacgccttcgacctggcccgcgaagtcccgatcagagcgaggctgttcgtgctcggcgagcgggagcacgtgctctgcctggtgatccatcacatcgccagcgacggctggtcgcgcaccccgctcgcccgcgacctcgccaccgcctacgccgcccgcggcgccgggcacgccccgcggtgggaggaactccccgtccagtacggcgactacaccctctggcagcgcgagctcctcggttcgcaggacgaccccgaaagcctgctcagccgccagacggcgtactggaagcagcggctcgcgggcctgccggacgccatcgaactgcccctcgaccgtcctcgcccgccgatcgccggccaccgcggcgacaccgtccccttcaccctcccgcccgcgacccacgagcgggtcgccgcgctcgccgcccgccacggcgcgaccaccttcatggtggtgcaggcggccctggccggcctgctgtcccggctgggcgcgggcaccgacatccccctgggcaccccggtggccggacgcaccgacgcggcgctggaggggctgatcggcttcttcgtcaacaccctggtgctgcgcacggacacctcggggaaccccaccttcgacgaactggtcgaacgggcccgcgcctgcgccctggacgcctacgcccaccaggacgtgccgttcgagcgactggtggagacgctcgcccccgagcgctccctggcccgccacccgctcttccaggtgagcctgagcctccagcacgccaccgaccacacggccctcctgaacggtctggagatcgcccccctggacaccggatggcgggcggccaagttcgacctctccttcgacctcctggagaagcgcggccccgacggccgcccggacggcatcgccggcaccgtcgagtactccaccgacgtcctcgacgccgccaccgtccgcgggctcggggaacgcctcgtccgcctgctggaggccggcaccgccgcccccgaggcgcggctgctctcgatcgacctgctctccgccgaggaacggcgccgcgtgctggaggagttcgccgccgagcccgcagccgacgagcccgcagccgccgagcccgcggccgacgaggggctggaggccgtgtgcgacaccttcgcccgccaggcggcggccacccccgaggccccggccgtcgtcggcggtccggtcgccctcaccttcgcggaggccgacgcccgcgtctcccgcctggcccggctgctgatctcccggggcgccggccccgaggtccgcgtcgccgtctgcctggaccgcaacgccctgtggccgacgaccgtgctggccgtgctgcgcagcggcgccgtccacgtaccgctggacccacgctccccgcacgagcggctggccgccgtcgaacgcgacgtcgcccccctgctcgtcctcgccgagcgcgccaccgaggccgccgtcgccgacctcgccgccccggtcctcgtcctggacgacccgagcaccgaggccgcgatcgacgccctggacccgggcccggtcaccgacgccgaccgcaccgcgcccctcctgcccgggcacgccgcctacgtcatccacacctcgggttccaccggcaggcccaagggggtcacggtggaccaccggggcctgtcgcggctgctccaggcgcaccgccgggtcaccttctcccgcatccgtccctccgcaggcggccccggccgcgccgcccacgtctcctccttctccttcgacgcctcgtgggacccgctgctcgcgatggtcgccggccacgaactgcacatgatcgacgaggacctgcggttcgacccgccgggcgtggtggcctacttccgcgaccgccgcatcgactacgtcgacctcacccccacctacttccgcagcctgctcgacgccggactgctggaggaaggcttcccctgcccgtccctcgttgccctgggcggcgaggcgatggacggcgaactgtgggagcggctgcgggcggccgccccccgcgtgaccgcgatgaacacctacggtcccaccgagaccgccgtcgacgccgtggtgaccgtactgggcgacctgcccccgggcacgatcggccggcccgtgccccgctggcgggcctacgtcctcgacgcgggactgcggccggtcccgcccggcgtgctgggcgagctgtacctcgccggacccggagtcgcccgcggctacctggggcagcacgccctgaccgccgagcggttcgtggcctgcccgttcgggaagccgggggagcggatgtaccgcaccggcgacctggcgcggtggctccccgacggccacctggtctatgtcggacgcggcgacgagcaggtcaagatccgagggttccgcatcgagcccggggaggtggaggccgcactgcgggaactggagggcgtcgcggccgccgccgtgaccgtccgtgaggacacccccggaacacgcagactggtggggtacgtcgtcggtacccccgacgccgacgacgcccggctccggcccgccgaggtgctggcacgcctgcgcgaccgactgcccgaccacctggtgccctcggcgttcgtccgcctccgtgaactgcccgtcaacaccagcggcaaactggaccgggccgcgctcccggcccccgaccccgcggacttccccgccggccggcgaccgcgcaccgccctggagcgggaggtgtgcgcgctgttcgcggaggtcctcggcgccgggagcgtcggcatcgacgacgacttcttcggccggggcggcgacagcatcctctccatccaactggtgggcagcgcccgccgggcgggcctcacgttcaccgtccggcaggtcttcgagctgcgcacccccgcggccctggccgccgccgcccgcaggaccgacgcggcaggcgacgaggaccccgctctcgccgtcggaccgctgccgctccttcccgtggtcgccgagaccctcgcggccggcgggccggtccactcgtacaaccagtcggtcgtcctcgcgtccccgccggacgccgcacccgacgacgtacgcgacgcgctccaggccctcctcgaccggcacgacgcgctgcgcgtccacgccgccccggcggccggccccggccgcctctgggacctccgggtggaggaggccggcacggtcgcggccgagcggtgcctgcgccggatcgacgcgaccggcatgtccgacgaggaactggcgcgggcgcaggccgccgaggccgtcacggcgcgcgcctgcctcgaccccctcgccggggccctcgtcagcgccgtctggttcgaccggggcgaccggccgggccggctcgtgctggtgatccaccacctcgccgtcgacggcgtctcctggcgcatcctcctcggcgacctccgtgaggcatggcgggcgttgcgcgccggccgccgccccgaactcccccgtacgggcacctcgctgcgcacctgggccacccggctcaccgaacgggccaccgacccggccgtcaccgcccaactggaccactggacggccacgctcgccgacggccccgcaccgggcagccggccgctggaccggacccgggacaccgtggccacctccgccgtcctcagcggcgaactgcccgcgtccctcaccaccgacctgctcggtccggccccggcggccttccgtgccggggtgaacgacctgctgctgaccgctttcgccctcgccgtcgcccactggcggggcgaggaggacgcaccggtcctggtggacctggagagccacggccggaccgaggaactggtgccgggggctgacctgtcccgcaccgtcggctggttcacctccgtccacccggtgcggctcgccgccggcagggtcaccgccgccgacctcgccgagcgcgccccggccgtcggcgacgcgatcaaacggatcaaggagcaactgcgcgccgtccccgacggagggctggggcacggtctgctgcgccacctgaaccccgacaccgccccccgcctccgaggcctcgcccgcgcgcggttcggcttcaactacctgggccggttcgccgccgagcagggcgcgggcgaggacagctggccgctgctcggcagcggccccgcgggccagcatccggacaccccgctcgaccacgagatcgaggtcaacgtcgtcacggccgagggtccggacgggccccggctgatcacccggtggacctacgccaccggtctgctcaccgaggaggaggtgcgccgcctcacgcggtcctggtcgctggcgctgcacgccgtcgtcggccacgccaccgccgagggagcgggcggcctcagcccctccgacgtggccgttcccgacctcggccaggccgagatcgaacagctcgaacgccgcaccggcaccgccttggaggacatcctgccggtcgcccccctccaggagggcctgctcttccacagcgtgtacgaccggcgcgccctggacgtctacgtcggccagctcgccttccgcctggagggagagatcgaccaggacgccctgcggacggccgccgccgcgctgctcgcccgccacaccagcctgcggaccggcttccaccaacgggagtccggccagtgggtgcaggccgtggcccggtcggtggagctgccgtggcagttccacgacctgctcgacccgcacggcgccggcggggccgccggtgccgcggacgccgggtccgggcgacgatgggaggagctggccgcggccgaacgcgtcgagcggttcgacctcacccgccccccgctcgtccgcttcctcctggcccgcaccgcccccgagcggtaccagttcgtgatcaccacccaccacacgatcgtcgacggctggtccatccccatcctgctgcgcgagctgctcgcgctctacggcggggacccgctgcccccggcccccggtcaccgcctccacgccgactggctggccgcacgcgacctggtggcggcgcgcgaggcgtggacgcgggcgctggcggacaccgaggggcccaccctgctcgcgcccggcgcgccgcgcgtcggagaagtgccccggtcggtacggctgaacctgcccgaggaggtctccgcacggctgctgacccgcgcccgcgaggccggggccaccctcaactcggtcgtccaggccgtctgggccctcgtcctcgcccaggagaccggccgctcggacgtcacgttcggcatcaccgtctcgggtcgcccggcggaactccccggggccgagaacctggtcggcatgctggtgaacaaggtcccgctgcgcgtccgtctccgcccggccgaacccctcatggaactggcccggcggctggagagggaacagctggaactcctggagcaccagcacgtcccgctcaccaccctgcaccgctggagcggcctgcccgaactcttcgacaccaccatggtgttcgagaactacccggcggaggtcaccgcccggcaggcgcccttccgcgcgtcgggcacggccagttacagccgcaaccactacccgctcacgctggtcggagccatgcgcgggaccgagctgaccgtccgtgtcgaccaccgccccgacctcttcgacgaggacttcgcccgctccctgggcgagcgggtgatcgccgccctcaccgaggccgccgaccaccccttcgtccccgccggcacgctcgacctgctcggtgccgaggagcgcgcccgcctcctggagtggggcaccggccccgcaccggaggacgccccacgcacctatgtcgacctgttcgaggagcaggccgcccgcacccccgacgcgccggcggtcatctcgtccgacggtgtcctcacctacgccgagctggaccggcaggcgaacggcgtcgcccggtggctggccggccgggccggatccgccggtggcgccgaggtccacatcggtgtgctggccccacgccgccccgaagtgctcgccgtcctgctcggcgtcctcaagtcgggcgccgcctacgtccccctggacgagcagtggccggccgaacgcctccgcacggtcctggaggactgccgccccgcgctcgtgctggccccgacggccgccaggagcgatgccgcgcgggagtccggcgcgacggtgctccccgtcgacccggccgccctcgccgcacacggtccccagaccccgaccgacgccgagcggatacgtcccctgacgcccggcgcagccgcgtacgccctctacacctcgggatccaccggccgccccaagggcgtggtgatcgaccacagcgccctggccgcgtacgtcggcggcgcgcgccgccgctaccccgacgcggccgggacctcgctggcccacacctcgctcgccttcgacctcaccgtcaccaccctcctcaccccgctcaccgcgggcggcgccgtgcgcctgggcgaactggacgagaccgcccgggacgccggggccaccctggtcaaggcgacgccctcgcacctgcccctgctgagcgagctgcccggagccctgaacgacgggggcaccctgatcctcggcggcgaggcgctgaccggcggccggctgcgcccctggcgcgaactgcaccccgacgcccaggtcgtcaacgcctacggtccgacggaactcacggtcaactgcaccgagtaccggctgccgaagggagaaccggtcggcgaagggccggtgcccatcggccgcccgttcgccggggtacgggtccacgtgctcggccccggcctgcgcccggtccccgccgaggtccccggcgagctgtacgtcagcggcgtcggggtggcccggggctatctgggccggccggccctgaccgccgagcggttcgtggcctgcccgttcggggagccgggggagcggatgtaccgcaccggcgacctcgtccgctggcggagcgacggccaactggagtacgtcggccgaagcgacgaccaggtcaaactgcgcggattccgcgtcgagaccgcggaggtcgcccgcgccctggagacctgcccctccgtcggaagcgcgatggtggtgctgcgcgaggaccagccgggcgaccagcgcctggtcggctacctcgtaccggccgccggaagcggcgcgctcgacaaggaggccgtgtcggacgcggtccgggcggtcctgcccgagtacatggtcccctcggcactggtggtgctggaagacggaccgccgctgacggtcaacggcaaggtcgaccggagcgcgctgccggcgccggaggcggagccggcccgcagcgcgggccgggcgccgcgcgggccgcgcgaggagatcctgtgcgggctcttcgccgacgtgctgggcgtgcgagcggtcggcgtggacgacgacttcttcgccctgggcggccactccctgctcgccatcgtcgtgatcagccggatcagggccctgctcgacgtggacgtggccatcgacgcgctcttcgaggcccccacggtggcccggctggccgcccacctcgacgggcccggacgcggtcacggcgcggtgcgcccggccgtgccacgccccggacgcctcccgctctcctacgcccagctccgcctgtggctcctccaccagatcgaggggccgagcgccacctacaccatcccgctggcgctgcgcctgaccggtccgctggacgtggcggcgctgcgggccgcgctgggggacgtggtcgcccggcacgagagcctgcgcaccgtcttcgccgaggacgagcacggcccgcaccagatcgtcctcgcgcccggggacgccgaacccggcctcaaggcggtccccaccacggaggaccgtctgaggtccgacctggaggccgaggccgcccgccccttcgacctcggccaggcaccgccggtccacgcccgcctcttcgtcctcgacgaacgcacccacgtcctgctgctggcggtccaccacatcgcgatggacggctggtcggtccgccctctggtgcgcgacctggcgtccgcctacgcggcccgccgccgaggcgcctccctggacctgcccgcacttcccgtgcagtacgccgactacaccctgtggcagcacgaggagctgggctccgaggacgacccggacagtcccctcgccgcgcaactgcggtactggcgccggaccctggacggcctgccgcaggagtccgcgccggccgccgaccggccccgtcccgccaccccctcgtaccggggcggccgcgtcgccctcaccgtcccgccggaactgcacgggcgggtggtggagttggcgcgggagttccgggcgacgccgttcatggtggtgcacgcggcgttggcggcgttgctgacgcggttgggcgcgggcacggacgtgccgatcggttcgccggtggccgggcgggtcgacgacgcgctggaggacctggtggggttcttcgtcaacacgctggtgctgcgcacggacacctcgggcgacccgaccttcggggagttgctggaacgggtgcgggccaccgacctgggggcctacgcccaccaggacctccccttcgaacgcctggtggaagtgctcaatccggagcgctccctcgcccgccacccgctcttccagatcctgctggccttcaacaacggcgcggcgcccgacgaaggacccgccgaccgggcgtcggacgtcctggtgcggccggagacggtggagatcgcggcggccaagttcgacctgtcgctgtccttcaacgaggaccgggcggccgacggcaccgcggccgggatgcggggcgtgctggagtacagcgccgacctgtacgacgagagcacggcccgcaggatggccgaacgctacctccggctgctcgaagcggcggtcgcggagccccgcaccccgctgagccgcattcccgtcctgagcgaggccgagctgcacgacgtcctcgtccggcgcaacgacactggtcgcacccggcccgactcctccccactgcgacggttcgaggcgcaggcggccacgactccccgggccacagccctggtcgtgggtgaggagcggctcgactacgccgaactcgacgcacgggccgagcggctcgccaccctgctgtcccggagcaccgccgggcgcggcggacccgtcgccgtcgccctgccgcgcggtgtcatgcttccggtggccctgctcgccgtctggaaggcgggcctgcactacctgccgctggaccccgaccacccgaggagccgcctggcggacgtcctcgccgactccgcgcccggctgcgtcatcacgacgaccgacctcgcgcgccgcctcccgccggtacccgccccgctgctcgtcctggacgatccggccaccgccgcacgcctggccgccaccaccgccacagccctggccgaggacccgcgggagcagaacggggagtggggggaggaactggcgtacaccatctacacctccggctccaccggccgtcccaagggcgtcatggtgacccggtcggccgtggcgaacttcctcgccgacatgaacgaacggctggaactgggccccggcgaccggttgctggcggtcaccacggtctccttcgacatcgccgtcctcgaactcctcgccccgctgctcaccggcggcacggtcgtcctcgccgacgccaccacccagcgcgaccccgcggccgtgaggtccctctgcgcccgcgagggcgtgacggtgatccaggccacccccagctggtggcacgccatggccgtggacggcggcctcgacctcacggccctgcgcgtgctggtgggcggcgaggcactgccgcccgccctcgcccgcaccctcctggaacccggccgcgcgccgctgggcgattacctgctcaacctgtacggacccacggagaccaccgtctggtccaccgtcgcgcggatcaccgccgattccttggaggcgcacggcggcgccgtgcccacggggacgccgatcgcccgcaccgccgcctacgtgctcgacgccgcgctgcggcccgtgcccgacggagtgccgggcgagctgtacctggccggcgccgggctggcccggggctatctgggccggccgggaatgaccgccgagcggttcgtggcctgcccgttcggggagccgggggagcggatgtaccgcaccggcgacctcgcccgctggcgggccgacggcaacctggaacacctgggcaggaccgacgaccaggtcaaggtccgcgggttcaggatcgaactgggcgaggtggaaagagccctgacgcaggcccacggcgtcggccgggccgccgccgccgtccaccccgacgccgccggctccgcccgactggtcggctatctggtaccggccggcggcagcggcgcactcgacgagaaggccgtcgccgacgccgtgcgggcggtgctgcccgcgtacatggtcccctcggcgctggtggtgctggacggcggcctgccgctgaccgcgaacggcaagctggaccgggccgcgcttcccgcgcccgaggcgacgaccggccgcggccccggccgggcgccgcgcgggccgcgcgaggagatcctgtgcgggctcttcgccgacgtactgggcgtgcccgcggtcggcgtggacgacgacttcttcgccctgggcggccactccctgctcgccacccggctcatcgcccgggtccgcggcacactcggcgtcgaactcggcgtccgagaggtcttcgagacaccgaccgtggccggtctcgccgccgcgctctccgcggcgggcgaggccggaccccggctgcgccccgccgacccgcgccccgagcgcctgcccctgtcccacgcccagcgccgcctgtggttcgtccggcaactggaggggccgagtgccacctacaacgtcccgtgggcgctgcgcctgaccggtccgctggacgtggcggcgctgcgggccgcgctgggggacgtggtcgcccggcacgagagcctgcgcaccgtcttcgccgaggacgagcacggcccgcaccaggtcgtcctgtccgccgacggcccggccccgctcagcgggcccgtccggaccgacgaggacgcactgccccgcctgctgcgggaagcggccgaccacgccttccggctggacgccgaaccgccgctgcgcgcccacctgttcgccaccgcgccggaggaccacaccctgctcctggtcatgcaccacatcgccaccgacgcctggtcgcagcggccgttgatcgccgatctggccgcggcctacgccgcccgccacgccggccgggtcccgacgctgccgccgctgccggtcgcctacgccgactacgccctgtggcagcaggcccgcctgggcgacgaacgggagaaggacagcgcgctgtccgcccaactcgcctactggcgcgacgcgctggcgggctccccggaggagctcgcgctgcccgccgaccggccccggcccgccgtcccctcgcaccggggggacagcgtgcccctcaccgtcccgccggaactgcacgggcgggtggtggagttggcgcgggagttccgggcgacgccgttcatggtggtgcacgcggcgttggcggcgttgctgacgcggttgggcgcgggcacggacgtgccgatcggttcaccggtggccgggcgggtcgacgacgcgctggaggacctggtggggttcttcgtcaacacgctggtgctgcgcacggacacctcgggcgacccgaccttcggggagttgctggaacgcgtacgggccaccgacctgggggcctacgcccaccaggacctccccttcgaacgcctggtggagctccgcgacccggaacgctcgctggcccgccacccgctcttccaggtctcgctgaactacgacacggccgagacggcccgagcacgcgatgccgcaccggaactggacgggctgaccgtgagcgggcgaccgctcggcgtcaccacgtccaagttcgacctcaccttcgcgctcaccgagacccgcgcccacgacggcggccccgccggactgcgcggcgcgctggagtacagcaccgacctgttcgaccgtggcaccgccgagcgcctggcggagcggttcgcacgggtcctccaggccgcggtggccgcccccggcaccaggctcgaccagatcgacgtgctgctgccgggcgaacgcgcgctcctggagggcgagtggagcaggcccgagcccggacccgtcgcccccacggacgacgcccgcttcccggacctcttcgaggcgcaggccgcccgcaccccgcacgcccccgccgtccgcgacggtgaccgggagctctcctacgccgagctgaacgaccgggccaaccggctggcccggttcctcgccgctcgcggagcgggccccgaggacaccgtcgccgtcctgctgccgcgcggccccgagctgatcaccgccctggtggccgtccagaaggccggggccgcctacgtccccatggacgccgagctgcccgccgagcggatcgcccacatgctggagaacgcccgcccggtgctcgtcctcgcccacaccgcaacccaggacgccctcccggagggggccggccccgtggtccgcctcgacgccccggccatcgaggcggcgctcgccgggctcgacggcggcgactgcaccgacgccgaccgccgcgcaccggccacgcaccacgacccggcctacgtcgtctacacctccgggtccaccggtacgcccaagggcgtcgtggtcgaacagcgctccctcgccgccttcctggtccgctcggccgcccggtaccgcggagccgccggaaccgcgctgctgcacggctcgccggccttcgacctcacggtcaccaccctgttcaccccgctgatcgccggaggctgcatcgtggtggcggacctcgacgctccggagcgggacgccccggcccgccccgacctgctcaaggtcactccctcccacctcgccctcctggacacgatcgcctcctgggcgacacccgcggccgacctggtcgtcgggggcgagcaactgaccgcgtcccgtctcgcccggctgcgccgggcacacccggacatgcgcgtcttcaacgactacggtcccaccgaagccaccgtgagctgcgccgacttcgtcctggaaccgggcgacgcaccgcccaccgacaccgtgccgatcggacgccccctggcgggacaccggctgttcgtcctggacgatcgcctgcgcccggtgcccgccaacgtccccggcgagctgtacgtcagcggcgtcggggtggcccggggctatctgggccggccgggaatgaccgccgagcggttcgtggcctgcccgttcggggagccgggggagcggatgtaccgcaccggcgacctcgcccgccggcgggccgacggaaacctggagtacctgggccgccgcgacggccaggtgaaggtgcgcggattccgcgtcgagacgggcgagatcgagaccgccctgctcgaccgcccggagatcggccaggccgccgtcgtcctgcgcggcgaacgcctcctcgcctacgtcgcggccccgccggagcggttcgacccggacgcgctccgccaggcgctcgcgtcccggctgccccggtacatggtccccgccgcgttcgtccggctggacgccctgccgctggctccgggaggcaagctcgaccaccgggcgctgcccgagccgccggcgcccgccgacgccccgcacgggagcaggccgccgcgcgacgcgtgggaaggcgtgctgtgcgaggcgttcggcgaggtgctggggatcgcggaggtcggggccgacgacgacttcttcgccctcggcggcgacagcatcggctccatccggctcgtcggccgggtgcgcgcggcgggcggccggatgaccgtccgcgacatcttcgaacagcgcacgcccgccgccctcgccggccgctcgcgccccggcggtccggcgaccgaggtactcggcggtcgcgggaccgggccggtggagccgacgccgatcagctcctggctggccgagctgggcggcgcggtcgacgggtacaaccagtccgtgctgctgcgcgtccccgccgaggccgacgcggccgtcgtgaccggcgccctccagacactgctggaccaccacgacgcgctgcggatgcgggccgaaccggaggacggtcactggcggatggagatcgccgaggcgggcgcggtggacgcggccaccgtgctggagcgggtggacgcggcgggcgccgatcaaggggagctggaccggctggtgcggacgcactgcgccgcggcccgtgaccggctcgccccgcagaagggctccgtcctgcgtgccgtctggttcgacggcgggccacgggagccgggacacctcgcgctcgtcgcccaccacctcgtcgtggacggagtctcctggcgcatcctcaccgccgacctcggcagcgcgtggcaggccctcgccgagggccgggaaccccacctcgacccggtgggcaccccgctgaggatctgggcccggcacctggcggagctggccgccgacccgcgccgcgccgagcggtgcgcccactgggaggagcagtcgccgcggccctgggagaccggcggtctcgaccccgccctcgacgaccggagcaccgaggaggccctttccctgaccctcccggccgccgccacccgcgccgtgctcggcccggtgcccgccgcgctcggcgtcggggtgagcgaagtcctgctcggaacgttcgccgccgccgtgcggcgccggcgtcccgcggaggccgcggacggcgtcacggtggacctggaaggccacggccgggaggaggacgtcgtccccggagcggacctctcccgcacggtcggctggttcaccgccgcccacccggtccgggtgcccgccgcgcggcccgacgaggaccggaccggcgcgctgcgggcgctggccgcgatcctggaccgggcgcccgacgccggcctcggctacggcctcctgcgctacctcaacccgcgcacccggcaacggctcgccgccctgcccgccccgcgctacggcttcaactacctgggcagattcggtggttcgggagaggaccgggacgcggacgaccggacgtcgaactggtcgccggtggccgccgggctcgccggccagcccgcccagctgcccctggcccacgagatcgaggtcaccgcggtcgccgtcgaggggcccgagggcccgcgtctgatcgccacctggtcctgggccggccggctccaccgggagcgggacgtccgcgaactggccgaactctggttccgcgagctggaggaactcgcgtccgccgaaccgcccccggccggccccgcgcccctgtccgacccgccccccctggtcgaactcaccgacaccgaactcgaccagctcgaagcagagtggaaggccggctgatgcgcggatccctacaggacgtcctgcccctctccccgctgcaggagggcctcctcttccacagcgaatacgtcggggacgaggccgtcgacgtctacaccgtccagaccgaggtggagctgcggggaccgctggacgtcccggcgctgcgcgcggcggccgaggccgtgctccgccgccacgacaacctgcgggccggcttcgcgacccgcgccctgaaggacccggtgcagttcgtcccccgcgaggtcgaactcccctgggaggaggccgacctgcgcgcggccgacgacccggacgcggaggcggcccgccgactggaggaacaccgctggcgccgtttcaggccctccaagccgcccctggtgcggttcctgctgctgcggacggcccacgaccgccaccgtttcgctctcaccaaccaccacatcctgctggacggttggtcgatgccgatgctgctgcgcgagctcatgctgctctaccgcaccgggggcgacgcctccgccctgccgccggtgcgccgctaccgggactacctggcctggctggggggccgcgaccgcgggaccgcacgggaggcctggcgcgccgctctggcgggtctggaggcgcccaccctcatcgccccgcgggccgaccgggccgcggaggcgccgacgtggctcgacttcacgctgtcggagaccgcctccgccggtctctccgcggccgcgcgagccgccggcctcacgctcaacacggtcgtgcaagggctgtgggccctgaccctggcacgcaccaccggcagccaggacgtggtgtacggggtggtcgtctccggacgtccgccggagctggacggcgtcgagtccatgatcggcctgttcgcgaacacggtcccgctgcgggcccggatgcccgtcgacgaacccctgacggatttcctgcggcggctgcagcgcgagcagagcgcgctcctggaccatcagcacctacggctggccgacatccagcggctggccggccagggcgagttgttcgattccgtgatggcgttcgagaactacccggacggccccgccgacgagccctccggcgcttccgccgacacgccgggacacgtccgcgtggtggcctcccggatgcgcgacgccatgcactacccgctcggcctcctggcgtcccccggaactcggatgcgcttccgcctcggccaccggcccagcgcggtcacgccgcgcctggccgccgccctgcgcgaccgcctgctgcggctcgtcgacgccttcctcgccaccccgcacctgccgctgggcaggttcgacgtcctcgacgacgccgaacgcgccctggtactggacacgttcaacgacaccgcgcacgaggtcgaggacaccaccgccgtcgagctgttcctccggcaggccgcccgcacccccgcccggatcgccgtggagacggccgaccgctccgtcgactacgcccggctcgccgaccgctccggccgcctggcccgcctgctggcggagcacggggcgcgggccgagcggttcgtcgccctcgtgctgccgcgctcgcccgaactggtcgaaaccgcgctcgccgtgtggcagaccggagccgcctacgtcccggtggaccccgcccacccggccgaccggatggcccggctgctgcgggaggccgaccccgtcctcaccgtcaccaccgccgacctggccgaccggctgccggccgggctccctctgctggtcctggacggcccgagcaccgccgccgccctccaggccctgcccggcggcccgctgaccgcgagtgagctccccgcgcccgtggacccccggaacgccgcctacgcgctctacacctccgggtccaccggccgccccaagggcgtggtcgccacccaccgctccctcgtcggctacctgctgcgcggctcggcccagtacccgtccgacggacgctccctggtgcactcgccggtctccttcgacctcaccgtcggcgccctgtacgtcccgctgatcagcggcggcaccgtgcgcctcgcctccctggacgacgaaccggtcctgcgccccggcgagacgccccccgacttcgtgaaggtgacccccagccacctgcccgtcctcgaagggctgccgggcgaggtcagcccgaccggggcgatcaccttcggcggcgaacagctcaccggccgccacctgcggcgctggcgcgccgaccacccggacgtcaccgtctacaacgtctacgggcccaccgagacgaccgtcaactgctccgagcaccgcatcgccccccgtgacccggtcggcgacgggccggtccccatcggacggccgctgtggaacacccgcctgttcgtcctgggccccggcctcgccccggtgccggtcggcgtgccgggcgagctgtacgtcgccggcgccggcctgacccgcggctacctccgcgatccgggcaggaccgccgagcgcttcgtcgcctgcccctacgccgccgggcaacggatgtaccgaaccggcgacctcgtccgctggaacgaggacgggctgctggagtacctgggcagggtggacgaccagatcagcctgcgcggcttccgggtggagcccggcgaggtggaggcggcgctggcggcccaccccgcggtccgccgcgccgcggtggtgctgcgggaggacacgcccggcgacgcccggctggtcgcctacgccgtccccgccgagccggaaggagcgcggagcacgccgccgtccccgctccccaccgagcagatcctggaacacctgcgccggaccctgccgccctacatggtccccgcgcacctcgtggaactgcccgcgctgcccgtcacgccccacggcaagatcgaccgggccgcgctgccggaaccctccgtcgccggcgccccggccggaggagcgccccgctccccccgggaggagatcctgtgcggcatcttcgccgaggtgctgcggcgcccgcgggtctccatcgacgacgacttcttcgccctgggcgggcactccctgctggccacccggctggccagcagggtgcgggcggccctggacacggagctgccggtgcgccgcctcttcgaacaccccacggtgcgctccctgtccgcactgctggaccccgacgccggcaggcgccctgcggtgacgcccgcacggcgacctgagcacgtcccgctctccttctcccagcagcggctgtggatcatgcaccggctcaccggccccgacgccacgtataacatccaccgggccctgcggctcgacggcgacctcgacgtcccggcgctggaggccgcgctgcacgacgtgaccgaacggcacgagacgctgcgcaccgtcttccccgagggccccgagggcccgtaccagaaggtcctcccggcccgacgggaggacgggaccctcaccgtcctcccggtcgccgaccgggaggtcgaccgcaccctcgccgagctggcggcccaccgcttcgacctggagtccgaaccgccgaagcgcgcctggctcctggagagcggtccgcgcagccgggtcctcgtcctggtgctccaccacatcgccagcgacggctggtcgggcaggcggctcctgcgcgacctgttcaccgcctacaccgcgcgccgcgcgggccgggcgccccaatggcgaccgctgccggtgcagtacgcggactacgccctgtggcagcggcgccacctcggcgaccccgcggaccccgccagtcccgccgccgtccaaggggagtactgggagaagcagttggccggactccccgaggaactgcggctgcccgccgaccggccgcgcccggcgcgcccgacccgcaccggcggccaggtgtggctgacgctcccggcgacggcccacgccgccgtggccgagctggccagaaccagccgggccagcgtgttcatggtcgtccaagccgccgtggccgccttcctcacccgcatgggcgccggggaggacatccccatcggcgccccggtcgccgggcgcaccgacgaagcggtggaggaactggtcggattcttcgtcagcaccctggtcctgcggaccgacacctccggtgacccctcgttcaccgaactcgtcggccgggtccgggaaaccgcgctggccgcctacgcccaccaggacctgcccttcgagtacgtggtggagcggctcagcccgacccggtccctcggccggcaccccctcttccaggtcgccctgtcctgcaacaacaccgaggagcagctgggccgccagggcgccccgccccccgggctctccgtcacaccgcaccaggtggacgccgcccgctcgaagttcgacctgatgttcaccttcctggagaaccacggcgaggacggccagcccacgggcatcgagaccgccctcgaatacagcgccgacctgttcgaccgggagaccgcgcagagcctcctcgaccgcttcgcccggatgctggcgatctgggcggcggaaccggccgccgccatcggcgctcgcgaactcctggcggccgacgagcggcacacggtggtcaccgcgtggaacgccacccggcgcgcggacctggtcgcgacactcccgcggatgttcgaggagcaggtcgcccgcaccccgcacgccacagccctcgaacacgccggccaccacctgacgtacgccgaactcaacgcccgagccaaccggttggccagagtgctggtgcgccgcggcatccgccccgaacaccgcgtcgccatcctgatgccgcgctccgtcgagcagatcaccgccctgctggccatcaccaaggccggcggcgccgccgtaccggtcgatcccggccaccccggacaacgcatcgccttcatgctgcgcgacagcgcctgcgccctgatcctggcggaccacccgcacgcggcgggacgtgaggagatcgccggcgtcccggtcctcgtccccgccgacgaaccggccccggaacgggccaccgacctcgccgacggcgaccgcaacgcccccctcaccgccggccacgccgcctacgtcgtctacacctccggttccacgggccgccccaagggcgtggtgaccgaacaccgcggcctgctgtcactggccacggcacagcgtgagcgatacccggtggggcccggcagccgggtgctgcaactcgcctcaccgtccttcgacggcgccgtactggaactgctcatggccctcaccaccggaggaaccctcgtcctgcccgacgggcccctcctcgccgggcaaccgctcgccgacatgctggccgagcaccgcatcagccacgccttcatccccccggcggtgctgagcggccttccctccgaagggctggagggcctgcgctgcctcgtcgtcggcggcgaggcggtcaccgcgcccctcacggaccgctgggcgcccggccgtcgcatgctcaacatctacggccccaccgagaccaccgccgtcaccctgaccagcgaagccctgacccccggcggcccaccgcccgccatcggcacccccgtacccaacaccagggcccacgtgctcgacgaccggctgcgccccgtcccgcccggcgtgacgggcgagctgtacctggccggcgcgtcactggcgcgcggctacggccgccgcccggcgctcaccgccagccgctacgtcggctgcccgttcggagcgccgggggagcggatgtaccgcaccggcgacctggcgcgcctggaccgggagggccgcgtccaccacatgggccgcaccgacgagcagatcaagctgcgcggcttccgcgtcgagcccggtgagatccgggcccggctcaccgagcatcccgccgtgcgggaggcggcggtcgtcctgcgcgacgacgggccgggcggacgcgcgctggtggcctacgcggtaccggccgacggcccgccccgccccaccgcggcccagctccgcgcacacctgaacgccctcctcccgccctacatggtgcccgccgccttcctggtgctggacgcgctgccgaccacccccaacggcaagctcgaccgggaggccctgcccgccccgcaaccgcacgccgaggagaccggccgtccgccgcgcgacgaacgcgaggccgccctgtgcgaggtgttcgccgaggtcctggagcgcacgtcgctcggcgccgacgacggcttcttcgagaacgggggacactcgctgctcgccgtccggctggtcgccagggtccgcgagcgcctgggcgtgcccctggccgcacgggacctgttcgaggctcccaccccggccgccctggcggagcgcctggcccgcggcgccgaacgccgcgccccggcgcccctgctcaccctgcggggccgcggcgaccggccccccttgttctgcgtccacccggccgtcggcctgggatgggcgtacgcgagcctcctgccgtggctcccggccgacgtccccctccacgcgctgcaggcccgcacgcccgcggacggcgccggtctgccggggagcgtcgaggagatggccgaggactacgtccggctgatccgccgcgtccgcccccacggcccctaccggctgctcggctggtcgctgggagcccacgtggcccacaccgcggcggccctgctggagcgcgacggacagcgggtggacctgctcgccatgctggacgcctatcctccccaccgcaccggggaccccggcggacgggccgaggagtccgaggccgagatcgtggcggccaacctgcgggagtcggggttcgcgtgggacgaggacgagcagcgcgcgggacgcttcccgctggagcgcttccgcgcccacctgcgccgggtggacagctcgctcggccacctcgacgacgccgaactgacggcggccaaggacgtctacgtcaacaacgtccggctcatgcgctccttcacccccggccgtgtccggtgcgggatcgtcctgatgaccgcggaacgcacccgcagcctcgatccggcggcgtgggagccgcacaccgaaggaggcgtcgaggtgcaccggctggacgcctcccacatgtccatgctgaccgaaccggcgtcggtcgcggcagccggccgtctcctgacccaccgactggagtccctgcggggagccaccacgaagaaacgagaggtatgacgatgaccaaccccttcgacgacaccgagggcgtcttccacgtcctggtcaacgacgagaaccagcactcgctgtggccccacttcgtcgagatccccgacggctggcgggccgtggtgcgcgagcgtccgcgccaggagtgcctggactacatcgaggcgaactggaccgacatgcgcccgcagagcctcatcgacgccatggaggcacacgagaagtccgagggcgcgatccggtgacccaagggcgcgg

SEQ ID NO: 7 - protein, 2595 aa, Streptomyces fradiae
PRVPARPAATPDPRALPERLPLSPAQRRLWFLNRYDREAGGYHISVALRLTGDLDVDALHAALGDLTARHESLRTVFREDEQGPHQVVLDPGAPPAPAVVPAAAHRIDALVREAVRRPFDLADDIPLRHTLFTLPDGEHVLLLVIHHIAADGWSMGPLARDLAAAYRARAAGRAPDWPAPAARPAAHPPGQHGDDVDDTVDRRLAHWAEELRGLPDELALPYDRPRPTTPPGYAERVPFRVDAALYRDVRALAARHRATPFMVLHAALAALWHRLGAGPDIPVGTPSAGRDRPETADLVGFLVNTLVLRTDTSGDPAFAELLDRVRETDLRAYAHQDVPFERLVEAVNPARSPSRHPLVQTMLTFDNAAHGALDHLLDLPGVRAELLPTAEGTAHTDIELTFTETTADTDGDGLDASLRYRPDLFDRTTARALAERFMALLRTVTREPALRLGQLDVTTAGERRRLADADAAARARTAATAVAVLPALFAASAHRTPAAPALTDGPATLDYAELDARSNRLARALLGLGVGPEDFVALAVPRSADLVVAVLAVLKSGAAYLAVDPDHPAERTSYILHDCRPVAVLSTTAVRETLHGTVGEAVGEVPWLLLDEPATGGATAGHSAAPVTDADRRSPLLPDHPAYTIYTSGSTGRPKGVVVSHANVSRLLTACRAAVDFGPDDVWTLFHSSAFDFSVWEMWGPLAHGGRLVVVPHDVARSPGDLLDLLGRERVTVLSQTPSAFLQLLRAESDLGVPPRTTAALRYVVFGGEALDTAQLAPWRGRPVRLVNMYGITETTVHVTHLELDDAAVDRGGSPIGTPLNDLRAHVLDQGLLPVPVGVVGELYVAGPGLARGYRRRPGLSATRFVADPFDTGGRMYRTGDLVRRTQDGGLHYVGRSDSQVKLRGYRIEPGEIEAAARRHPDVAQAATAVHGEGPQDRYLVCYVVPAADTDPDPHQVRAHLADALPGYMVPAAVVPLTALPLTPNGKLDRAALPAPDRAAWATGGAPTGPREEALCAAFADVLGVQEVSRDADFFALGGHSLSAVRLISRIRSALGVEIGIRTLFEAPTPAALSRRLDTAGTGRPRLLPRRRPDRVPLSSAQRRLWFLGELEGPSATYNIPLALRLRGRLDVDALRTALADVVGRHEALRTVFPSEDGAPYQQVVAAERAAPALDVVDVTEKELPAALAEARAHAFTLTEDLPLRAVLLRTGPADHVLSLVLHHIAGDGWSLAPLARDLSTAYAARREGRAPQWRPLPVQYADHTLWKEELLGAADDPESLLARQLAFWREALEGAPEQIELPTDRPRPAMESHRGAIHRFTLPASLRDRLRDLAHARRATLFMALQAGLAALFATLGAGRDIVLGTPVAGRADEAADDLVGFFVNTLALRTDLGGDPTFEELLDRVREADLSAFAHQDIPFEQLVEALNPTRSLSRHPVFQVLLALQNNERGEAVMPGLEVTVERPAQAAAKYDLFVNLVESRNEEDGTTAVEGAVEYATDLFDARTVARLTERYHDLLLAAVEEPTTRLSRMPMLDTAERDRLTAEWGAAAAGPAEDLVALFRARAAETPGAVAVRGAGDSLTYAQLDERAGRIAAALARHGAGPESRVAVCLPRTADLVAALLGVLRAGAAYVPLDPEYPDERVAAILADTRPVALLTTADCRPAITGAATAAGGAVLLAADAAHGAGPVPEPPAPLPDQAAYVLHTSGSTGRPKGVVVSRGNLANLLADMRDRLRPTADDRLVAVTTVSFDIAALELFLPLVTGAGLVLADRGAARAPEELAALLTASGATLLQATPTTWQLLAETAPDALRGLRKLVGGEALPASLASRLRELGGELVNVYGPTETTIWSTAAHLDRVTGSAPPIGRALRGTRAYVLDEWLNPRPENVPGELYLAGAGVARGYLGRGGLTAERFTADPFGAPGSRMYRTGDLVRRRADGELEFLGRTDHQVKVRGFRIELGEIETALGAHPHVAGAVVVARAASGAALVPDAPAPRRLVAYVVPEPHRAAPDDGREQNRLDEWREAYDTLYGSSAPAPLGQDFGIWRSSHDGQPIPLDEMHQWRAATVDRIRALRPTRVLEIGVGTGLLLSELAEDCTAYHGTDLSARAIETLRAQVDAEPALKERVELHVRPAHDFDGLRRGFYDTIVLNSVVQYFPDADHLTRVLRGALDLLAPGGRLFVGDVRSLALLRAFRASVETGNSAVSETPAAVLAAADRRTAAENELVIAPDYFARLRREAREPLLLDVRIRRGRPYNELTRYRYDVLLVKQETGAAPSALPPATELRWTPETGDAGRLAEICAAHPGALRVTAIPNARVRRETTALAALEDGRPVTEVRRLLEQPGDGVDPEDLYDAATAAGRTAWVTWSADGPPDTVDLVLAPAGGDGVPPVAPPAELWPGAPAADRPETNDPTAGSHHRELAARLRSHLAERLPDYMVPSAVVVLDALPLTANGKVDRNALPDPDPAGTDAGRPPRTPREELLCTLFADLLGLGRVGVQDSFFGLGGDSVLSVRLVSRARAHGLPLTTRDVFEHHTAAALAAALDGREPESEPDGGPPGPDATAARPITLDELAELEAEFGTDWEETQ

SEQ ID NO: 8 - DNA, 7788 bp, Streptomyces fradiae
cccagggtcccggcgcggcccgcggcgacccccgacccgcgggcgctgcccgagcggctgcccctgtcgcccgcccagcgcaggctgtggttcctcaaccgctacgacagggaggccggcggctaccacatcagcgtcgcgctgcggctcaccggcgatctcgacgtcgacgccctccacgcggcactgggcgacctgaccgcccggcacgagagcctgcgcaccgtcttccgcgaggacgaacaggggccgcaccaggtcgtcctggacccgggggccccgcccgcacccgccgtcgtcccggctgccgcccaccgcatcgacgccctggtgcgcgaagccgtccgccgccccttcgacctggccgacgacatcccgctgcgccacaccctcttcacgctcccggacggcgaacacgtcctgctcctggtcatccaccacatcgccgccgacggctggtcgatggggccgctggcacgggacctggccgccgcctaccgcgcccgcgccgccggccgcgcgcccgactggcccgccccggccgcccgccccgccgcacacccgcccggacagcacggcgacgacgtggacgacacggtggaccgccgcctcgcccactgggccgaggaactgcgcggactgcccgacgaactcgcgctgccctacgaccggccgcgccccacgacaccccccggctacgccgagcgggtccccttccgcgtcgacgccgcgctgtaccgggacgtgcgggcgctggcggcccgccaccgggccaccccgttcatggtcctccacgccgccctggccgccctgtggcaccggctcggcgccggccccgacatccccgtgggcaccccgtccgccggccgcgaccggcccgagaccgccgacctcgtcggcttcctggtcaacaccctggtcctgcgcaccgacacctcgggcgacccggccttcgccgaactgctcgaccgggtgcgcgagaccgacctgcgggcctacgcccaccaggacgtgcccttcgagcggctggtggaggcggtcaaccccgcccgctcgcccagcaggcacccgctcgtccagacgatgctcaccttcgacaacgccgcccacggagcgctcgatcacctcctggacctgccgggcgtgcgcgcggaactgctgccgaccgccgagggcaccgcccacaccgacatcgaactgaccttcaccgagaccacggcggacaccgacggcgacggactcgacgcgtccctgcgctaccgccccgacctgttcgaccgcacgaccgcgcgggctctggcggagcggttcatggcgctgctccgcaccgtgacgcgcgagcccgccctgcggctcgggcagctcgacgtcaccaccgccggggaacgccggcggctggccgacgcggacgccgcggcacgggcgaggacggccgccaccgccgtcgccgtcctgcccgccctcttcgccgcctccgcccatcgcacgcccgccgcccccgccctcaccgacggcccggcgaccctggactacgcggaactcgacgcccgctccaaccgtctcgcccgggccctgctcggactcggcgtggggccggaggacttcgtcgccctggcggtgccccgctcggcggacctggtggtggccgtcctcgcggtgctgaagtcgggcgccgcctacctcgccgtcgaccccgaccacccggccgagcgcacctcgtacatcctccacgactgccggcccgtcgccgtcctctccacgaccgccgtccgcgagaccctgcacggcacggtgggcgaggcggtcggcgaggtcccgtggctgctgctcgacgagcccgccaccggcggcgcgacggccggccactcggccgcaccggtcaccgacgccgaccgccggtcgcccctgctccccgaccacccggcctacaccatctacacctccggctcgaccggacggcccaagggcgtcgtcgtcagtcacgccaacgtctcacgactgctgaccgcctgccgcgcggccgtggacttcgggcccgacgacgtctggacgctcttccactccagcgccttcgacttctcggtgtgggagatgtgggggccgctggcgcacggcggccggctggtcgtcgtcccgcacgacgtggccagatcacccggcgacctcctggacctgctgggccgcgagcgcgtcacggtgctcagccagacgccctccgccttcctccagctcctgcgggcggagtccgacctcggcgtccccccgaggaccaccgcggcgctgcggtacgtcgtcttcggcggagaagcgctggacaccgcccaactcgccccctggcggggccgcccggtccgcctggtcaacatgtacgggatcaccgagacgaccgtccacgtcacccacctggagctggacgacgccgccgtggaccgcggcggcagcccgatcggcacacccctgaacgacctgcgcgcccacgtgctcgaccaggggctgcttcccgtgccggtgggcgtcgtgggcgagctgtacgtcgccggccccggcctggcccgcggctaccgccgccgccccggcctgagcgccacccgcttcgtcgccgacccgttcgacaccggcggccggatgtaccggaccggcgacctcgtccggcgcacccaggacggcggcctccactacgtcggccggtccgactcccaggtgaaactgcgcggctaccgcatcgagcccggcgagatcgaggccgccgcccgccgccacccggacgtcgcccaggcggccaccgccgtgcacggcgaaggaccgcaggaccggtacctggtctgctacgtggtgccggcggccgacaccgaccccgacccgcaccaggtgcgcgcccacctggccgacgccctgcccggctatatggtccccgccgccgtggtgccgctgaccgccctgccgctgacccccaacggcaagctggaccgagcggcgctgcccgcccccgaccgggcggcgtgggccaccggcggcgccccgaccggaccgcgcgaggaagcgctctgcgccgccttcgccgacgtcctcggcgtccaggaggtcagccgcgacgccgacttcttcgccctgggaggccattccctctcggcggtccggctcatcagccggatcaggtcggcgctcggagtggagatcggcatccgcacgctcttcgaggcgcccacgcccgccgcgctgtcccggcgcctcgacaccgccgggaccggacggccccgcctcctgccgcgccgccgaccggaccgcgtcccgctctcctccgcccagcgcaggctgtggttcctcggagaactggaaggaccgagcgccacctacaacatcccgctcgccctgcgcctgcgcggccgtctcgacgtcgacgccctgcgcaccgccctggccgacgtggtgggccggcacgaggccctgcgcaccgtcttcccgtccgaggacggcgccccctaccagcaggtggtcgcggccgaacgggccgcgcccgccctcgacgtcgtggacgtcaccgagaaggagctgcccgccgccctcgccgaggcccgcgcacacgccttcaccctcaccgaggaccttccgctgcgggccgtactgctgcggaccggccccgccgaccacgtgctctccctcgtcctccaccacatcgcgggcgacggctggtcgctggccccgctcgcccgcgacctcagcaccgcctacgccgcacgtcgggagggccgcgccccgcagtggcggcccctgccggtgcagtacgccgaccacaccctctggaaagaggagttgctcggcgcggcggacgaccccgagagcctcctcgcccgccaactcgccttctggcgcgaggcgctggagggcgcgccggaacagatcgagctacccaccgaccggccgcgccccgccatggagagccaccgcggcgcgatccaccgcttcaccctccccgcgtcactgcgcgaccggctgcgtgacctcgcgcacgcgcggcgggccaccctcttcatggccctccaggccggactcgccgcactgttcgccaccctgggggccggccgggacatcgtcctcggcacgcctgtcgccggccgcgccgacgaggcggccgacgacctcgtcggcttcttcgtcaacaccctggcgctccgcaccgacctcggcggcgaccccaccttcgaggaactgctcgaccgcgtcagggaagccgacctgtccgccttcgcccaccaggacatcccgttcgagcaactggtggaggcgctcaaccccacccgctccctctccaggcaccccgtcttccaggtgctgctggccctccagaacaacgagcgcggcgaggccgtcatgccgggcctggaggtcaccgtcgaacgccccgcccaggcggcggccaagtacgacctcttcgtcaacctcgtggagtcccggaacgaggaggacggaacgaccgccgtcgagggagcggtcgagtacgccaccgacctcttcgacgcccgtaccgtcgcccggctcaccgagcgctaccacgacctgctcctggccgccgtcgaggagcccacgacacggctcagccggatgcccatgctcgacacggcggaacgcgacagactcacggccgaatggggcgccgccgccgcgggcccggccgaggacctggtcgccctcttccgtgcccgcgccgccgagacacccggcgcggtggcggtccgcggcgccggggacagcctcacctacgcccagctcgacgagcgggccggacggatcgcggcggccctcgcccggcacggcgccggccccgagagcagggtcgcggtgtgtctgccgcgcaccgccgacctggtggccgcgctgctcggcgtcctacgggccggcgccgcctacgtaccgctcgacccggagtacccggacgagcgcgtcgccgcgatcctggccgacacccgcccggtggcgctgctcaccacggcggactgccgccccgcgatcaccggggccgcgaccgccgccggcggagccgtcctcctcgcggccgacgccgcacacggcgcgggccccgtgcccgagccccccgccccgctgcccgaccaggccgcgtacgtcctgcacacctcgggctccaccggacgccccaagggcgtcgtcgtcagccggggcaacctcgccaacctcctggccgacatgcgggaccggctgcgccccaccgccgacgaccggctggtcgccgtcaccacggtcagcttcgacatcgccgcgctggaactcttcctcccgctggtcaccggcgccggactggtcctggccgaccgcggcgccgcacgggcccccgaggaactggccgccctgctcaccgcgagcggtgccaccctcctccaggccaccccgaccacctggcagttgctggccgagaccgcccccgacgccctgcgcgggctgcgcaagctggtcggcggcgaagccctccccgcctccctggcctcccgactgcgcgagctgggcggcgaactcgtcaacgtctacgggcccaccgagaccaccatctggtcgaccgccgcccacctcgaccgggtcaccggcagcgccccgcccatcggccgggcgctgcgcggcacccgcgcctacgtgctggacgagtggctgaacccgcgccccgagaacgtccccggcgagctgtacctggccggcgccggcgtggcccgcggctacctgggacgcggtggcctgaccgcggagcgcttcaccgccgaccccttcggcgcgcccggcagccgcatgtaccgcacgggcgacctggtccgccgccgcgcggacggggagctggaattcctcggacgcaccgaccaccaggtcaaggtccggggcttccgcatcgaactgggcgagatcgagacggcactcggcgcgcacccgcacgtcgccggggcggtcgtggtcgcccgcgcggcgtccggcgcggccctcgtgccggacgcgccggccccacggcgactggtggcctacgtggtccccgagccccaccgcgccgcccccgacgacggccgggagcagaaccggctcgacgagtggcgggaggcctacgacaccctctacggcagctccgcacccgcccccctcggccaggacttcggcatctggcgcagcagtcacgacgggcagcccatccccctggacgagatgcaccagtggcgggcggccacggtggaccgcatccgggcgctgcggcccacgcgggtgctggagatcggagtcggcaccgggctgctgctctcggagctggcggaggactgcaccgcctaccacggcaccgacctgtccgcgcgggcgatcgagacgctgcgcgcacaggtcgacgccgaacccgcgctgaaggagagggtcgagctgcacgtccgcccggcccacgacttcgacggcctgcgccggggcttctacgacaccatcgtgctcaactccgtcgtccagtacttccccgacgccgaccacctcacccgcgtactgcgcggcgcgctcgacctgctcgcccccggcgggcggctcttcgtcggcgacgtccgcagcctggcactgctgcgcgccttccgcgcctcggtggagaccggcaacagcgcggtctccgaaactcccgccgccgtacttgccgccgccgaccgcaggacggccgcggagaacgaactcgtcatcgcccccgactacttcgcgcggctgcggcgggaggcccgcgaaccgctcctgctggacgtgcgcatccggcgcggacggccgtacaacgagctgacgcgctaccgctacgacgtcctgctggtcaaacaggagaccggagccgcgccctccgccctgcccccggccaccgaactgcgctggacgccggagaccggcgatgccgggcggctggccgagatctgcgcggcgcaccccggcgcgctgcgcgtcaccgcgatccccaacgcccgcgtgcggcgcgagaccaccgccctcgccgccctggaggacgggcgaccggtcaccgaggtgcgccggctgctggagcaacccggtgacggagtcgatccggaggacctgtacgacgccgcgaccgccgccggacgcaccgcctgggtgacctggtcggccgacggaccgccggacaccgtggacctcgtgctggccccggcgggcggggacggcgtgccgccggtggcgccgccggccgagctgtggcccggcgcgccggccgctgaccggccggagacgaacgacccgaccgccgggtcgcaccaccgcgaactggccgcccggctccgctcccacctggccgaacggctgccggactacatggtcccctcggccgtcgtcgtcctcgacgccctcccgctgaccgccaacgggaaggtggaccgcaacgcgctgcccgaccccgacccggcgggcacggacgccggccgcccgccgcgcacgccccgggaggaactgctctgcacgctcttcgccgacctgctgggcctgggccgggtcggagtccaggacagcttcttcggcctcggcggcgacagcgtcctgtccgtccgcctcgtcagccgcgcccgcgcacacgggctgccgctgaccacccgcgacgtcttcgagcaccacaccgccgccgcgctggcggcggccctggacggcagggaaccggagagcgaaccggacggcggcccgccgggccccgacgccaccgcggcgcggcccatcaccctcgacgaactcgccgagctcgaggccgagttcggcacggactgggaggagacacagtga

SEQ ID NO: 9 - protein, 2143 aa, Streptomyces fradiae
VNGPQRMVEEVLAVTPLQEGLLFHAVFDENVPDAYVSRLVLALSGELDADRLRQAAQALVARHPALRSAFRQRRSGEWFQLVATRPAVPWQELDLRPSGSPAEADKHLEALLDEHHRTGFDLGRPPLLRFLLARTGDDHHRLAVTYHHLVLDGWSMPILMRELAVLYGSGGDPSALPPVRPHRDHLDWLARRPSERSARAWRQALAGLPGPTLIAPDADRNGPLPGSVWTRLGERDTHALGAWARARGVTVNSAVQAAWATVIGRLTGRDDVVFGTTVSGRPPDLPGSEDMVGFFINTVPTRVRMRPAEPIGDLVVRIQREQTALMEHQHVRLSDIQRWSDRTVLFDTSTAFENYPADDLSAVSSAGHAGLRIEGGSGRTTNHFPLSLYALPGPALRLRLDHRPDAVDDVTTRHAADLLERALTAVHSAPATPTAALAATPATARAAAPRAAGPGAPATIVDAFEARVRATPEAPAVLAGGEELTYAELDARANRLARLLLERGVGPESRVALTVSRNAWLPVAVLGILKAGGCYVPVGATLPRERAARILRETAPVCLLTDPDAEAARTRRTAPTGDDRDENAPGGVERVVLTGALLAAFDPAPPTDAERAGPLLPGHLAYLLHTSGSSGRPKGVAVEHAQVTALLSWAGTGVGADRLHRTVASTSESFDVSVFDTLVPLLTGGRIEIVENTLAVADRTGGEPSLLNAVPSALQALLERGEPLAVHTFLCAGEPFPAPLARSLRAAFPRARVANLYGPTETTVFVTAHFLDGTDDGAPPVGRPLPGVRVHILDPWLRPVPDGVVGELYLAGEHVTRGYWQRPATTAERYVADIFGAPGARMYRSGDLGRLRPDGEIDLVGRADDQVKVRGHRVELGEVEAALASHPDVLRAAAAVHDGKPAGPRLVGYVVPRGPAPDTAAVLDHVRREVPPYMVPSALVVLDELPLTVNGKRDRAALPPPPDRSDTTRARAPRGPHETILLGLFAEVLGVRPVGIDDDFFALGGHSLLATRLVSRVRTTLGAELAVRDLFEHPTVAGLYARIARAGAARPPVSRVHARPDRVPLSFAQRRLWFLHRLQGHSAAYHVPLALRLTGRLDPAALRGAIADTVARHGSLRTVFHEDAEGVRQIVQDASAAARLITLIPEPVEDPLRAAEEAVAEPFDLTAGPPLRCRLFTRSADPADPRAGAGQEPQEHLFLLVVHHIAADGWSLRIIARDVAAAYAARVRGEDFAPAPPPVDYVDHTLWQHRVLGDPDADGGPDTEGGHATEGGPLDTQLAHWRRRLAGLPQEIALPADRQRPAASSHRGADVDFTVPAAAAERIRQLAGTTGTTPFMVLQAALAVLLHRMGAGTDIPLGTPVAGRTDSAVEGVVGLFVNTLVLRTDLSGSPTFAQLLGRVRATALDAYAHQDVPFERLVEVLAPERSLARHPLFQVSLVLQNLDEAAAPVDGLPGLRAETVRTRRDGAKVDLSFVLAPGGPEGGDMPGVLTYSADLFDHATARGLVDRLLRVLDQVLAAPATPVGRVDVLLPGEARRELEHSRGPGAAGDGDEPLARFEKWAATTPDAPALRWDGGRLTYAELDRKADAVARALVGRSLGPEDVVAVVAPRDPDVVAALLGVLRCGAAYLPIDEAWPPARIRRTTTDAGARLLLAPGDTDAARTAFGPACGPDTDILGLEDPAFRATGGPALPAGRNHPRSLAYVLYTSGSTGRPKGVGVERRALAHYVEGAVHRYPDAAATTLLHSPLTFDLSATALFTPLASGGCVVLGEVDRAAEAHPVDFVKATPSHLPLLERRPGLLGENGTLVLGGEALDGRALRAWRAAHPHAEVVNAYGPTELTVNCAEHRIAAGEPVPDGPVPIGRPFAGVRAMVLDTALAPAPPGVAGELYVTGPGVARGYLGQRALTAERFVACPFGEPGERMYRTGDLVRRLPGGELEYVGRTDEQVKLRGFRIELPEVARTLAADESVARAVVVVREDRPGDRRLTGYVVPAAGVRPHEDELRGAVARTLPDYMVPSAVVVLDELPTTPHGKLDRRALPAPAHRSRGGRPPRDQRERDLCRIYADVLGLPEVGAEDDFFALGGHSLLATRLVNRIRAELAEELDVRTVFEARTVAALAARLRTARPDTRPALRRMSRSEDL

SEQ ID NO: 10 - DNA, 6432 bp, Streptomyces fradiae
gtgaacggtccgcagcgcatggtcgaggaggtcctggcggtcaccccgctccaggaggggctgctcttccacgccgtcttcgacgagaacgtccccgacgcctacgtcagccggctggtcctggccctttccggagagctggacgccgaccggctgcgacaggccgcccaggcgctggtggcacgccacccggcgctgcgctcggccttccgccagcggcgctcgggggagtggttccaactggtcgccacccgccccgcggtgccctggcaggagctcgacctgcggccgtcggggagcccggcggaggcggacaagcacctggaggcgctgctggacgagcaccaccgcaccgggttcgacctcggccggccgcccctgctgcgcttcctgctggccaggaccggcgacgaccaccaccggttggccgtgacctatcaccacctcgtcctcgacggctggtccatgcccatcctgatgcgggaactggccgtgctgtacggcagcggcggcgacccgtccgccctcccgcccgtccgcccgcaccgcgaccacctcgactggctggcccgccgcccgtccgagcggagcgcccgcgcctggcggcaggcgctggcgggactgcccggccccacgctgatcgccccggacgccgaccgcaacgggccgctccccgggtcggtgtggacccggctcggcgagcgggacacccatgccctcggggcgtgggcgcgggcccgcggcgtgacggtgaactcggcggtgcaggccgcctgggccaccgtgatcggccgcctcaccggccgcgacgacgtcgtcttcggcacgacggtctcggggcggccgccggatctgcccggcagcgaggacatggtcgggttcttcatcaacaccgtgccgacgcgcgtgcggatgaggccggccgagccgatcggcgacctcgtcgtgcggatccagcgcgagcagaccgccctcatggagcaccagcacgtccggctctccgacatccagcgctggtccgaccggaccgtgctcttcgacacctccaccgcgttcgaaaactaccccgccgacgacctgtccgccgtcagctccgccgggcacgcgggactgcgtatcgagggaggctccggccgcaccaccaaccacttcccgctctccctctacgcgctccccggcccggcgctccgcctgcgcctggaccaccgccccgacgccgtggacgacgtcaccacacgccacgcggcggatctgctggaacgtgctctgaccgccgtccacagcgccccggccaccccgaccgccgcgctcgccgccacccccgcgacggcacgcgcggccgcaccccgcgccgccgggccgggcgccccggccacgatcgtggacgcgttcgaggcgcgtgtgcgggcgacccccgaggcccccgccgtcctcgccggcggcgaggagctgacctacgccgaactcgacgcccgggcgaaccggctggcgcgcctgctgctggagcgaggggtcggacccgagagccgggtcgccctcaccgtctcccggaacgcctggctgcccgtcgccgtgctcggcatcctcaaggcgggcggctgctacgtccccgtgggcgccacgctgccgcgggagcgcgccgcccgcatcctccgcgagaccgcaccggtctgtctgctcaccgaccccgacgccgaggccgcccggacccgccgcaccgcccccacgggagacgaccgggacgagaacgcgccgggcggcgtcgagcgcgtcgtgctgaccggcgccctcctggccgcgttcgacccggccccgccgaccgacgccgaacgggccggacccctgctccccggccatctcgcctacctcctccacacctccggctccagcggccggcccaaaggggtcgccgtcgaacacgcccaggtgaccgccctgctgtcctgggccggcaccggcgtcggagccgaccgtctgcaccggaccgtggcctccacctcggagagcttcgacgtgtcggtcttcgacaccctcgtcccgctgctcaccggcggccgcatcgagatcgtggagaacaccctggccgtcgccgaccggaccggcggcgaaccctccctcctgaacgccgtcccctcggccctgcaggcgctgctggagcgcggcgagccgctcgccgtccacaccttcctctgcgccggcgaacccttccccgccccactggcccgcagcctgcgcgccgccttcccgcgggcgcgcgtggccaacctctacggaccgaccgagacgaccgtcttcgtcaccgcccacttcctggacggaaccgacgacggcgcgccccccgtcggccgcccgctgcccggtgtgcgcgtccatatcctcgacccctggctccgtcccgtgccggacggcgtcgtcggggagctgtacctcgccggggaacacgtcacccgcggctactggcagcgcccggcgacgacggccgaacgctacgtcgccgacatcttcggcgcgcccggcgcccgcatgtaccgcagcggcgacctcggacggctccgccccgacggggagatcgacctggtcggccgggcggacgaccaggtaaaggtgcgcggccaccgggtcgagctgggagaggtggaggccgccctggcctcccacccggacgtcctgcgggccgcagccgccgtgcacgacggcaaacccgccggaccgcgcctggtgggctacgtcgtgccccgcgggccggcgcccgacaccgccgccgtcctggaccacgtgcgccgcgaggtgcccccttacatggtgccctcggcgctcgtggtgctggacgagctgccgctgaccgtcaacggcaagcgggaccgcgccgcactgccgcccccgcccgaccggagcgacaccacgcgggcgcgcgccccccgaggcccgcacgagacgatcctgctcggactgttcgccgaggtgctcggggtacgcccggtcggcatcgacgacgacttcttcgccctgggcggccactcgctgctcgccacccgcctggtcagccgggtgcgcaccaccctcggagccgaactggcggtgcgggacctcttcgaacaccccacggtggccggtctgtacgccaggatcgcccgcgccggggcggcccggccgccggtctcccgcgtccacgcgcggcccgaccgcgtccccctctcgttcgcccagcggcggttgtggttcctccaccgcctccagggccacagcgccgcctaccacgtcccgctcgcgctccgcctcaccggacgcctcgacccggccgcgctgcgcggcgcgatcgccgacacggtcgcccggcacggaagcctgcgcaccgtcttccacgaggacgccgagggcgtccgccagatcgtccaggacgcctcggccgccgcccggctgatcaccctgatcccggagcccgtcgaggacccgctgcgggcggcggaggaggcggtggcagaacccttcgacctgacggccggaccgcccctgcggtgcaggctgttcacccggtccgcggacccggcggacccgcgcgcgggcgccggccaggagccgcaagaacacctgttcctcctggtggtgcaccacatcgcggccgacggctggtcgctgcggatcatcgcccgggacgtggccgccgcgtacgccgcccgcgtgcgcggtgaggacttcgcgcccgccccgccccccgtcgactacgtcgaccacaccctctggcagcaccgggtgctcggcgaccccgacgcggacggcggccccgacacggagggcggccacgccacggagggcggcccgctcgacacccagctcgcgcactggcggcggcggctggccggcctgccgcaggagatcgcgctgccggccgaccggcagcgcccggccgcctcctcccaccggggcgcggacgtggacttcaccgtccccgccgccgcggccgaacggatcaggcaactggcgggaaccaccggcaccacgcccttcatggtcctccaggccgcactggcggtcctgctgcaccgcatgggggcggggaccgacatcccgctgggcaccccggtcgccgggcgcaccgacagcgcggtcgagggagtcgtcggactcttcgtcaacaccctggtcctgcgcaccgacctgagcggctcgcccaccttcgcccagctcctgggccgggtccgggccaccgccctggacgcctacgcccaccaggacgtgccgttcgaacggctggtcgaggtgctcgcccccgagcgctccctggcccgccaccccctcttccaggtctccctcgtcctgcagaacctcgacgaggcggcggcgccggtggacggactgcccgggctgcgcgccgaaacggtccgcacccggcgcgacggcgcgaaggtcgacctgtccttcgtgctggctcccggcggaccggaaggcggggacatgcccggagtcctcacctacagcgccgacctcttcgaccacgcgaccgcgagagggctcgtggaccggctgctgcgggtgctggaccaggtgctcgccgcccccgccacgcctgtggggcgggtggacgtgctcctgcccggcgaggcgcggcgcgagctggagcacagccgcggaccgggcgcggcgggagacggggacgaaccgctggcacgcttcgagaagtgggcggcgaccacccccgacgcccccgccctgcggtgggacggcggccgtctgacctacgccgagctggaccggaaggcggacgcggtggcccgcgcgctcgtcgggcgctccctcgggcccgaggacgtggtcgcggtcgtcgctccgcgcgacccggacgtggtggccgcactcctcggggtgctcaggtgcggcgccgcgtacctcccgatcgacgaggcatggccgcccgcacggatccggcggacgaccaccgacgccggcgcgcgcctgctcctggcgccgggcgacaccgacgccgcccggaccgccttcggccccgcctgcggcccggacaccgacatcctcggcctcgaggacccggccttccgggccaccggcggtccggcccttccggccgggcggaaccacccgcgctcgctggcgtacgtcctctatacctccggctccaccgggcgccccaagggcgtgggcgtggagcgccgggcactcgcgcactacgtggaaggggcagtccaccgctacccggacgcggcggcgacgaccctgctccactccccgctgaccttcgacctcagcgccaccgccctgttcacccccctcgcctcgggcggctgcgtcgtcctgggcgaggtggaccgtgcggcggaggcccacccggtggacttcgtcaaggcgaccccgtcccacctgcccctgctggaacggcgtcccggactgctcggggagaacggcaccctcgtcctgggcggggaagccctcgacgggcgggccctgcgcgcctggcgggccgcccacccgcacgccgaggtcgtcaacgcctacggccccacggagctgaccgtcaactgcgccgagcaccgcatcgccgccggcgaaccggtgccggacgggccggtaccgatcggccgcccgttcgccggcgtccgcgcgatggtgctcgacacggcacttgcccccgcacccccgggcgtggccggggagctgtacgtcacggggcccggagtggcccgcggctacctggggcagcgcgccctgaccgccgagcggttcgtggcctgcccgttcggggagccgggggagcggatgtaccgcaccggcgacctcgtccgccgccttcccggcggcgaactggagtacgtgggccgaacggacgagcaggtgaagctgcggggcttccggatagaactgcccgaggtggcgcgcaccctggccgccgacgagtcggtcgcgcgcgcggtcgtcgtcgtacgggaggaccgtccgggcgaccggcggctgaccggctacgtggtcccggcggcgggagtccgcccgcacgaggacgaactgcgcggcgcggtggcccgcacgctgcccgactacatggtgccctccgccgtcgtcgtcctcgacgaactgcccaccacgccccacggaaaactcgaccggcgcgcgctccccgccccggcacaccgctcgcggggcggccgcccgccgcgcgaccagcgcgagcgggacctgtgccggatctacgccgacgtgctgggcctgcccgaggtgggcgccgaggacgacttcttcgccctcggcggccactccctgctcgccacccggctggtcaaccggatccgggccgaactcgccgaagaactcgacgtacggaccgtgttcgaggcccgaacggtcgccgcgctggcggcccggctgcggaccgcccgccctgacacccgccccgcgttgcgacggatgtcgcggtcggaggacttgtga

SEQ ID NO: 11 - protein, 5245 aa, Streptomyces fradiae
MLPLSLAQQRLWFLHTMDGPSSTYNIPTALRMTGPLDVTALGEALRDVVRRHETLRTVFPDTGDGARQHVLPADGTAVELAVTRSTEHELPAALAHEAGHAFDLAREVPIRARLFVLGEREHVLCLVIHHIASDGWSRTPLARDLATAYAARGAGHAPRWEELPVQYGDYTLWQRELLGSQDDPESLLSRQTAYWKQRLAGLPDAIELPLDRPRPPIAGHRGDTVPFTLPPATHERVAALAARHGATTFMVVQAALAGLLSRLGAGTDIPLGTPVAGRTDAALEGLIGFFVNTLVLRTDTSGNPTFDELVERARACALDAYAHQDVPFERLVETLAPERSLARHPLFQVSLSLQHATDHTALLNGLEIAPLDTGWRAAKFDLSFDLLEKRGPDGRPDGIAGTVEYSTDVLDAATVRGLGERLVRLLEAGTAAPEARLLSIDLLSAEERRRVLEEFAAEPAADEPAAAEPAADEGLEAVCDTFARQAAATPEAPAVVGGPVALTFAEADARVSRLARLLISRGAGPEVRVAVCLDRNALWPTTVLAVLRSGAVHVPLDPRSPHERLAAVERDVAPLLVLAERATEAAVADLAAPVLVLDDPSTEAAIDALDPGPVTDADRTAPLLPGHAAYVIHTSGSTGRPKGVTVDHRGLSRLLQAHRRVTFSRIRPSAGGPGRAAHVSSFSFDASWDPLLAMVAGHELHMIDEDLRFDPPGVVAYFRDRRIDYVDLTPTYFRSLLDAGLLEEGFPCPSLVALGGEAMDGELWERLRAAAPRVTAMNTYGPTETAVDAVVTVLGDLPPGTIGRPVPRWRAYVLDAGLRPVPPGVLGELYLAGPGVARGYLGQHALTAERFVACPFGKPGERMYRTGDLARWLPDGHLVYVGRGDEQVKIRGFRIEPGEVEAALRELEGVAAAAVTVREDTPGTRRLVGYVVGTPDADDARLRPAEVLARLRDRLPDHLVPSAFVRLRELPVNTSGKLDRAALPAPDPADFPAGRRPRTALEREVCALFAEVLGAGSVGIDDDFFGRGGDSILSIQLVGSARRAGLTFTVRQVFELRTPAALAAAARRTDAAGDEDPALAVGPLPLLPVVAETLAAGGPVHSYNQSVVLASPPDAAPDDVRDALQALLDRHDALRVHAAPAAGPGRLWDLRVEEAGTVAAERCLRRIDATGMSDEELARAQAAEAVTARACLDPLAGALVSAVWFDRGDRPGRLVLVIHHLAVDGVSWRILLGDLREAWRALRAGRRPELPRTGTSLRTWATRLTERATDPAVTAQLDHWTATLADGPAPGSRPLDRTRDTVATSAVLSGELPASLTTDLLGPAPAAFRAGVNDLLLTAFALAVAHWRGEEDAPVLVDLESHGRTEELVPGADLSRTVGWFTSVHPVRLAAGRVTAADLAERAPAVGDAIKRIKEQLRAVPDGGLGHGLLRHLNPDTAPRLRGLARARFGFNYLGRFAAEQGAGEDSWPLLGSGPAGQHPDTPLDHEIEVNVVTAEGPDGPRLITRWTYATGLLTEEEVRRLTRSWSLALHAVVGHATAEGAGGLSPSDVAVPDLGQAEIEQLERRTGTALEDILPVAPLQEGLLFHSVYDRRALDVYVGQLAFRLEGEIDQDALRTAAAALLARHTSLRTGFHQRESGQWVQAVARSVELPWQFHDLLDPHGAGGAAGAADAGSGRRWEELAAAERVERFDLTRPPLVRFLLARTAPERYQFVITTHHTIVDGWSIPILLRELLALYGGDPLPPAPGHRLHADWLAARDLVAAREAWTRALADTEGPTLLAPGAPRVGEVPRSVRLNLPEEVSARLLTRAREAGATLNSVVQAVWALVLAQETGRSDVTFGITVSGRPAELPGAENLVGMLVNKVPLRVRLRPAEPLMELARRLEREQLELLEHQHVPLTTLHRWSGLPELFDTTMVFENYPAEVTARQAPFRASGTASYSRNHYPLTLVGAMRGTELTVRVDHRPDLFDEDFARSLGERVIAALTEAADHPFVPAGTLDLLGAEERARLLEWGTGPAPEDAPRTYVDLFEEQAARTPDAPAVISSDGVLTYAELDRQANGVARWLAGRAGSAGGAEVHIGVLAPRRPEVLAVLLGVLKSGAAYVPLDEQWPAERLRTVLEDCRPALVLAPTAARSDAARESGATVLPVDPAALAAHGPQTPTDAERIRPLTPGAAAYALYTSGSTGRPKGVVIDHSALAAYVGGARRRYPDAAGTSLAHTSLAFDLTVTTLLTPLTAGGAVRLGELDETARDAGATLVKATPSHLPLLSELPGALNDGGTLILGGEALTGGRLRPWRELHPDAQVVNAYGPTELTVNCTEYRLPKGEPVGEGPVPIGRPFAGVRVHVLGPGLRPVPAEVPGELYVSGVGVARGYLGRPALTAERFVACPFGEPGERMYRTGDLVRWRSDGQLEYVGRSDDQVKLRGFRVETAEVARALETCPSVGSAMVVLREDQPGDQRLVGYLVPAAGSGALDKEAVSDAVRAVLPEYMVPSALVVLEDGPPLTVNGKVDRSALPAPEAEPARSAGRAPRGPREEILCGLFADVLGVRAVGVDDDFFALGGHSLLAIVVISRIRALLDVDVAIDALFEAPTVARLAAHLDGPGRGHGAVRPAVPRPGRLPLSYAQLRLWLLHQIEGPSATYTIPLALRLTGPLDVAALRAALGDVVARHESLRTVFAEDEHGPHQIVLAPGDAEPGLKAVPTTEDRLRSDLEAEAARPFDLGQAPPVHARLFVLDERTHVLLLAVHHIAMDGWSVRPLVRDLASAYAARRRGASLDLPALPVQYADYTLWQHEELGSEDDPDSPLAAQLRYWRRTLDGLPQESAPAADRPRPATPSYRGGRVALTVPPELHGRVVELAREFRATPFMVVHAALAALLTRLGAGTDVPIGSPVAGRVDDALEDLVGFFVNTLVLRTDTSGDPTFGELLERVRATDLGAYAHQDLPFERLVEVLNPERSLARHPLFQILLAFNNGAAPDEGPADRASDVLVRPETVEIAAAKFDLSLSFNEDRAADGTAAGMRGVLEYSADLYDESTARRMAERYLRLLEAAVAEPRTPLSRIPVLSEAELHDVLVRRNDTGRTRPDSSPLRRFEAQAATTPRATALVVGEERLDYAELDARAERLATLLSRSTAGRGGPVAVALPRGVMLPVALLAVWKAGLHYLPLDPDHPRSRLADVLADSAPGCVITTTDLARRLPPVPAPLLVLDDPATAARLAATTATALAEDPREQNGEWGEELAYTIYTSGSTGRPKGVMVTRSAVANFLADMNERLELGPGDRLLAVTTVSFDIAVLELLAPLLTGGTVVLADATTQRDPAAVRSLCAREGVTVIQATPSWWHAMAVDGGLDLTALRVLVGGEALPPALARTLLEPGRAPLGDYLLNLYGPTETTVWSTVARITADSLEAHGGAVPTGTPIARTAAYVLDAALRPVPDGVPGELYLAGAGLARGYLGRPGMTAERFVACPFGEPGERMYRTGDLARWRADGNLEHLGRTDDQVKVRGFRIELGEVERALTQAHGVGRAAAAVHPDAAGSARLVGYLVPAGGSGALDEKAVADAVRAVLPAYMVPSALVVLDGGLPLTANGKLDRAALPAPEATTGRGPGRAPRGPREEILCGLFADVLGVPAVGVDDDFFALGGHSLLATRLIARVRGTLGVELGVREVFETPTVAGLAAALSAAGEAGPRLRPADPRPERLPLSHAQRRLWFVRQLEGPSATYNVPWALRLTGPLDVAALRAALGDVVARHESLRTVFAEDEHGPHQVVLSADGPAPLSGPVRTDEDALPRLLREAADHAFRLDAEPPLRAHLFATAPEDHTLLLVMHHIATDAWSQRPLIADLAAAYAARHAGRVPTLPPLPVAYADYALWQQARLGDEREKDSALSAQLAYWRDALAGSPEELALPADRPRPAVPSHRGDSVPLTVPPELHGRVVELAREFRATPFMVVHAALAALLTRLGAGTDVPIGSPVAGRVDDALEDLVGFFVNTLVLRTDTSGDPTFGELLERVRATDLGAYAHQDLPFERLVELRDPERSLARHPLFQVSLNYDTAETARARDAAPELDGLTVSGRPLGVTTSKFDLTFALTETRAHDGGPAGLRGALEYSTDLFDRGTAERLAERFARVLQAAVAAPGTRLDQIDVLLPGERALLEGEWSRPEPGPVAPTDDARFPDLFEAQAARTPHAPAVRDGDRELSYAELNDRANRLARFLAARGAGPEDTVAVLLPRGPELITALVAVQKAGAAYVPMDAELPAERIAHMLENARPVLVLAHTATQDALPEGAGPVVRLDAPAIEAALAGLDGGDCTDADRRAPATHHDPAYVVYTSGSTGTPKGVVVEQRSLAAFLVRSAARYRGAAGTALLHGSPAFDLTVTTLFTPLIAGGCIVVADLDAPERDAPARPDLLKVTPSHLALLDTIASWATPAADLVVGGEQLTASRLARLRRAHPDMRVFNDYGPTEATVSCADFVLEPGDAPPTDTVPIGRPLAGHRLFVLDDRLRPVPANVPGELYVSGVGVARGYLGRPGMTAERFVACPFGEPGERMYRTGDLARRRADGNLEYLGRRDGQVKVRGFRVETGEIETALLDRPEIGQAAVVLRGERLLAYVAAPPERFDPDALRQALASRLPRYMVPAAFVRLDALPLAPGGKLDHRALPEPPAPADAPHGSRPPRDAWEGVLCEAFGEVLGIAEVGADDDFFALGGDSIGSIRLVGRVRAAGGRMTVRDIFEQRTPAALAGRSRPGGPATEVLGGRGTGPVEPTPISSWLAELGGAVDGYNQSVLLRVPAEADAAVVTGALQTLLDHHDALRMRAEPEDGHWRMEIAEAGAVDAATVLERVDAAGADQGELDRLVRTHCAAARDRLAPQKGSVLRAVWFDGGPREPGHLALVAHHLVVDGVSWRILTADLGSAWQALAEGREPHLDPVGTPLRIWARHLAELAADPRRAERCAHWEEQSPRPWETGGLDPALDDRSTEEALSLTLPAAATRAVLGPVPAALGVGVSEVLLGTFAAAVRRRRPAEAADGVTVDLEGHGREEDVVPGADLSRTVGWFTAAHPVRVPAARPDEDRTGALRALAAILDRAPDAGLGYGLLRYLNPRTRQRLAALPAPRYGFNYLGRFGGSGEDRDADDRTSNWSPVAAGLAGQPAQLPLAHEIEVTAVAVEGPEGPRLIATWSWAGRLHRERDVRELAELWFRELEELASAEPPPAGPAPLSDPPPLVELTDTELDQLEAEWKAG

SEQ ID NO: 12 - DNA, 15738 bp, Streptomyces fradiae
atgcttcccctctccctcgcccagcagcggctgtggttcctccacacgatggacggccccagctccacctacaacatccccacggcgttgcggatgaccggcccgctggacgtcaccgcgctgggcgaggccctgcgcgacgtcgtacggcgccacgagacgcttcgcaccgtcttccccgacaccggcgacggcgcccggcagcacgtcctgcccgccgacgggaccgccgtcgagctggccgtcacccgttccaccgagcacgaactgcccgccgcgctggcccacgaggccggccacgccttcgacctggcccgcgaagtcccgatcagagcgaggctgttcgtgctcggcgagcgggagcacgtgctctgcctggtgatccatcacatcgccagcgacggctggtcgcgcaccccgctcgcccgcgacctcgccaccgcctacgccgcccgcggcgccgggcacgccccgcggtgggaggaactccccgtccagtacggcgactacaccctctggcagcgcgagctcctcggttcgcaggacgaccccgaaagcctgctcagccgccagacggcgtactggaagcagcggctcgcgggcctgccggacgccatcgaactgcccctcgaccgtcctcgcccgccgatcgccggccaccgcggcgacaccgtccccttcaccctcccgcccgcgacccacgagcgggtcgccgcgctcgccgcccgccacggcgcgaccaccttcatggtggtgcaggcggccctggccggcctgctgtcccggctgggcgcgggcaccgacatccccctgggcaccccggtggccggacgcaccgacgcggcgctggaggggctgatcggcttcttcgtcaacaccctggtgctgcgcacggacacctcggggaaccccaccttcgacgaactggtcgaacgggcccgcgcctgcgccctggacgcctacgcccaccaggacgtgccgttcgagcgactggtggagacgctcgcccccgagcgctccctggcccgccacccgctcttccaggtgagcctgagcctccagcacgccaccgaccacacggccctcctgaacggtctggagatcgcccccctggacaccggatggcgggcggccaagttcgacctctccttcgacctcctggagaagcgcggccccgacggccgcccggacggcatcgccggcaccgtcgagtactccaccgacgtcctcgacgccgccaccgtccgcgggctcggggaacgcctcgtccgcctgctggaggccggcaccgccgcccccgaggcgcggctgctctcgatcgacctgctctccgccgaggaacggcgccgcgtgctggaggagttcgccgccgagcccgcagccgacgagcccgcagccgccgagcccgcggccgacgaggggctggaggccgtgtgcgacaccttcgcccgccaggcggcggccacccccgaggccccggccgtcgtcggcggtccggtcgccctcaccttcgcggaggccgacgcccgcgtctcccgcctggcccggctgctgatctcccggggcgccggccccgaggtccgcgtcgccgtctgcctggaccgcaacgccctgtggccgacgaccgtgctggccgtgctgcgcagcggcgccgtccacgtaccgctggacccacgctccccgcacgagcggctggccgccgtcgaacgcgacgtcgcccccctgctcgtcctcgccgagcgcgccaccgaggccgccgtcgccgacctcgccgccccggtcctcgtcctggacgacccgagcaccgaggccgcgatcgacgccctggacccgggcccggtcaccgacgccgaccgcaccgcgcccctcctgcccgggcacgccgcctacgtcatccacacctcgggttccaccggcaggcccaagggggtcacggtggaccaccggggcctgtcgcggctgctccaggcgcaccgccgggtcaccttctcccgcatccgtccctccgcaggcggccccggccgcgccgcccacgtctcctccttctccttcgacgcctcgtgggacccgctgctcgcgatggtcgccggccacgaactgcacatgatcgacgaggacctgcggttcgacccgccgggcgtggtggcctacttccgcgaccgccgcatcgactacgtcgacctcacccccacctacttccgcagcctgctcgacgccggactgctggaggaaggcttcccctgcccgtccctcgttgccctgggcggcgaggcgatggacggcgaactgtgggagcggctgcgggcggccgccccccgcgtgaccgcgatgaacacctacggtcccaccgagaccgccgtcgacgccgtggtgaccgtactgggcgacctgcccccgggcacgatcggccggcccgtgccccgctggcgggcctacgtcctcgacgcgggactgcggccggtcccgcccggcgtgctgggcgagctgtacctcgccggacccggagtcgcccgcggctacctggggcagcacgccctgaccgccgagcggttcgtggcctgcccgttcgggaagccgggggagcggatgtaccgcaccggcgacctggcgcggtggctccccgacggccacctggtctatgtcggacgcggcgacgagcaggtcaagatccgagggttccgcatcgagcccggggaggtggaggccgcactgcgggaactggagggcgtcgcggccgccgccgtgaccgtccgtgaggacacccccggaacacgcagactggtggggtacgtcgtcggtacccccgacgccgacgacgcccggctccggcccgccgaggtgctggcacgcctgcgcgaccgactgcccgaccacctggtgccctcggcgttcgtccgcctccgtgaactgcccgtcaacaccagcggcaaactggaccgggccgcgctcccggcccccgaccccgcggacttccccgccggccggcgaccgcgcaccgccctggagcgggaggtgtgcgcgctgttcgcggaggtcctcggcgccgggagcgtcggcatcgacgacgacttcttcggccggggcggcgacagcatcctctccatccaactggtgggcagcgcccgccgggcgggcctcacgttcaccgtccggcaggtcttcgagctgcgcacccccgcggccctggccgccgccgcccgcaggaccgacgcggcaggcgacgaggaccccgctctcgccgtcggaccgctgccgctccttcccgtggtcgccgagaccctcgcggccggcgggccggtccactcgtacaaccagtcggtcgtcctcgcgtccccgccggacgccgcacccgacgacgtacgcgacgcgctccaggccctcctcgaccggcacgacgcgctgcgcgtccacgccgccccggcggccggccccggccgcctctgggacctccgggtggaggaggccggcacggtcgcggccgagcggtgcctgcgccggatcgacgcgaccggcatgtccgacgaggaactggcgcgggcgcaggccgccgaggccgtcacggcgcgcgcctgcctcgaccccctcgccggggccctcgtcagcgccgtctggttcgaccggggcgaccggccgggccggctcgtgctggtgatccaccacctcgccgtcgacggcgtctcctggcgcatcctcctcggcgacctccgtgaggcatggcgggcgttgcgcgccggccgccgccccgaactcccccgtacgggcacctcgctgcgcacctgggccacccggctcaccgaacgggccaccgacccggccgtcaccgcccaactggaccactggacggccacgctcgccgacggccccgcaccgggcagccggccgctggaccggacccgggacaccgtggccacctccgccgtcctcagcggcgaactgcccgcgtccctcaccaccgacctgctcggtccggccccggcggccttccgtgccggggtgaacgacctgctgctgaccgctttcgccctcgccgtcgcccactggcggggcgaggaggacgcaccggtcctggtggacctggagagccacggccggaccgaggaactggtgccgggggctgacctgtcccgcaccgtcggctggttcacctccgtccacccggtgcggctcgccgccggcagggtcaccgccgccgacctcgccgagcgcgccccggccgtcggcgacgcgatcaaacggatcaaggagcaactgcgcgccgtccccgacggagggctggggcacggtctgctgcgccacctgaaccccgacaccgccccccgcctccgaggcctcgcccgcgcgcggttcggcttcaactacctgggccggttcgccgccgagcagggcgcgggcgaggacagctggccgctgctcggcagcggccccgcgggccagcatccggacaccccgctcgaccacgagatcgaggtcaacgtcgtcacggccgagggtccggacgggccccggctgatcacccggtggacctacgccaccggtctgctcaccgaggaggaggtgcgccgcctcacgcggtcctggtcgctggcgctgcacgccgtcgtcggccacgccaccgccgagggagcgggcggcctcagcccctccgacgtggccgttcccgacctcggccaggccgagatcgaacagctcgaacgccgcaccggcaccgccttggaggacatcctgccggtcgcccccctccaggagggcctgctcttccacagcgtgtacgaccggcgcgccctggacgtctacgtcggccagctcgccttccgcctggagggagagatcgaccaggacgccctgcggacggccgccgccgcgctgctcgcccgccacaccagcctgcggaccggcttccaccaacgggagtccggccagtgggtgcaggccgtggcccggtcggtggagctgccgtggcagttccacgacctgctcgacccgcacggcgccggcggggccgccggtgccgcggacgccgggtccgggcgacgatgggaggagctggccgcggccgaacgcgtcgagcggttcgacctcacccgccccccgctcgtccgcttcctcctggcccgcaccgcccccgagcggtaccagttcgtgatcaccacccaccacacgatcgtcgacggctggtccatccccatcctgctgcgcgagctgctcgcgctctacggcggggacccgctgcccccggcccccggtcaccgcctccacgccgactggctggccgcacgcgacctggtggcggcgcgcgaggcgtggacgcgggcgctggcggacaccgaggggcccaccctgctcgcgcccggcgcgccgcgcgtcggagaagtgccccggtcggtacggctgaacctgcccgaggaggtctccgcacggctgctgacccgcgcccgcgaggccggggccaccctcaactcggtcgtccaggccgtctgggccctcgtcctcgcccaggagaccggccgctcggacgtcacgttcggcatcaccgtctcgggtcgcccggcggaactccccggggccgagaacctggtcggcatgctggtgaacaaggtcccgctgcgcgtccgtctccgcccggccgaacccctcatggaactggcccggcggctggagagggaacagctggaactcctggagcaccagcacgtcccgctcaccaccctgcaccgctggagcggcctgcccgaactcttcgacaccaccatggtgttcgagaactacccggcggaggtcaccgcccggcaggcgcccttccgcgcgtcgggcacggccagttacagccgcaaccactacccgctcacgctggtcggagccatgcgcgggaccgagctgaccgtccgtgtcgaccaccgccccgacctcttcgacgaggacttcgcccgctccctgggcgagcgggtgatcgccgccctcaccgaggccgccgaccaccccttcgtccccgccggcacgctcgacctgctcggtgccgaggagcgcgcccgcctcctggagtggggcaccggccccgcaccggaggacgccccacgcacctatgtcgacctgttcgaggagcaggccgcccgcacccccgacgcgccggcggtcatctcgtccgacggtgtcctcacctacgccgagctggaccggcaggcgaacggcgtcgcccggtggctggccggccgggccggatccgccggtggcgccgaggtccacatcggtgtgctggccccacgccgccccgaagtgctcgccgtcctgctcggcgtcctcaagtcgggcgccgcctacgtccccctggacgagcagtggccggccgaacgcctccgcacggtcctggaggactgccgccccgcgctcgtgctggccccgacggccgccaggagcgatgccgcgcgggagtccggcgcgacggtgctccccgtcgacccggccgccctcgccgcacacggtccccagaccccgaccgacgccgagcggatacgtcccctgacgcccggcgcagccgcgtacgccctctacacctcgggatccaccggccgccccaagggcgtggtgatcgaccacagcgccctggccgcgtacgtcggcggcgcgcgccgccgctaccccgacgcggccgggacctcgctggcccacacctcgctcgccttcgacctcaccgtcaccaccctcctcaccccgctcaccgcgggcggcgccgtgcgcctgggcgaactggacgagaccgcccgggacgccggggccaccctggtcaaggcgacgccctcgcacctgcccctgctgagcgagctgcccggagccctgaacgacgggggcaccctgatcctcggcggcgaggcgctgaccggcggccggctgcgcccctggcgcgaactgcaccccgacgcccaggtcgtcaacgcctacggtccgacggaactcacggtcaactgcaccgagtaccggctgccgaagggagaaccggtcggcgaagggccggtgcccatcggccgcccgttcgccggggtacgggtccacgtgctcggccccggcctgcgcccggtccccgccgaggtccccggcgagctgtacgtcagcggcgtcggggtggcccggggctatctgggccggccggccctgaccgccgagcggttcgtggcctgcccgttcggggagccgggggagcggatgtaccgcaccggcgacctcgtccgctggcggagcgacggccaactggagtacgtcggccgaagcgacgaccaggtcaaactgcgcggattccgcgtcgagaccgcggaggtcgcccgcgccctggagacctgcccctccgtcggaagcgcgatggtggtgctgcgcgaggaccagccgggcgaccagcgcctggtcggctacctcgtaccggccgccggaagcggcgcgctcgacaaggaggccgtgtcggacgcggtccgggcggtcctgcccgagtacatggtcccctcggcactggtggtgctggaagacggaccgccgctgacggtcaacggcaaggtcgaccggagcgcgctgccggcgccggaggcggagccggcccgcagcgcgggccgggcgccgcgcgggccgcgcgaggagatcctgtgcgggctcttcgccgacgtgctgggcgtgcgagcggtcggcgtggacgacgacttcttcgccctgggcggccactccctgctcgccatcgtcgtgatcagccggatcagggccctgctcgacgtggacgtggccatcgacgcgctcttcgaggcccccacggtggcccggctggccgcccacctcgacgggcccggacgcggtcacggcgcggtgcgcccggccgtgccacgccccggacgcctcccgctctcctacgcccagctccgcctgtggctcctccaccagatcgaggggccgagcgccacctacaccatcccgctggcgctgcgcctgaccggtccgctggacgtggcggcgctgcgggccgcgctgggggacgtggtcgcccggcacgagagcctgcgcaccgtcttcgccgaggacgagcacggcccgcaccagatcgtcctcgcgcccggggacgccgaacccggcctcaaggcggtccccaccacggaggaccgtctgaggtccgacctggaggccgaggccgcccgccccttcgacctcggccaggcaccgccggtccacgcccgcctcttcgtcctcgacgaacgcacccacgtcctgctgctggcggtccaccacatcgcgatggacggctggtcggtccgccctctggtgcgcgacctggcgtccgcctacgcggcccgccgccgaggcgcctccctggacctgcccgcacttcccgtgcagtacgccgactacaccctgtggcagcacgaggagctgggctccgaggacgacccggacagtcccctcgccgcgcaactgcggtactggcgccggaccctggacggcctgccgcaggagtccgcgccggccgccgaccggccccgtcccgccaccccctcgtaccggggcggccgcgtcgccctcaccgtcccgccggaactgcacgggcgggtggtggagttggcgcgggagttccgggcgacgccgttcatggtggtgcacgcggcgttggcggcgttgctgacgcggttgggcgcgggcacggacgtgccgatcggttcgccggtggccgggcgggtcgacgacgcgctggaggacctggtggggttcttcgtcaacacgctggtgctgcgcacggacacctcgggcgacccgaccttcggggagttgctggaacgggtgcgggccaccgacctgggggcctacgcccaccaggacctccccttcgaacgcctggtggaagtgctcaatccggagcgctccctcgcccgccacccgctcttccagatcctgctggccttcaacaacggcgcggcgcccgacgaaggacccgccgaccgggcgtcggacgtcctggtgcggccggagacggtggagatcgcggcggccaagttcgacctgtcgctgtccttcaacgaggaccgggcggccgacggcaccgcggccgggatgcggggcgtgctggagtacagcgccgacctgtacgacgagagcacggcccgcaggatggccgaacgctacctccggctgctcgaagcggcggtcgcggagccccgcaccccgctgagccgcattcccgtcctgagcgaggccgagctgcacgacgtcctcgtccggcgcaacgacactggtcgcacccggcccgactcctccccactgcgacggttcgaggcgcaggcggccacgactccccgggccacagccctggtcgtgggtgaggagcggctcgactacgccgaactcgacgcacgggccgagcggctcgccaccctgctgtcccggagcaccgccgggcgcggcggacccgtcgccgtcgccctgccgcgcggtgtcatgcttccggtggccctgctcgccgtctggaaggcgggcctgcactacctgccgctggaccccgaccacccgaggagccgcctggcggacgtcctcgccgactccgcgcccggctgcgtcatcacgacgaccgacctcgcgcgccgcctcccgccggtacccgccccgctgctcgtcctggacgatccggccaccgccgcacgcctggccgccaccaccgccacagccctggccgaggacccgcgggagcagaacggggagtggggggaggaactggcgtacaccatctacacctccggctccaccggccgtcccaagggcgtcatggtgacccggtcggccgtggcgaacttcctcgccgacatgaacgaacggctggaactgggccccggcgaccggttgctggcggtcaccacggtctccttcgacatcgccgtcctcgaactcctcgccccgctgctcaccggcggcacggtcgtcctcgccgacgccaccacccagcgcgaccccgcggccgtgaggtccctctgcgcccgcgagggcgtgacggtgatccaggccacccccagctggtggcacgccatggccgtggacggcggcctcgacctcacggccctgcgcgtgctggtgggcggcgaggcactgccgcccgccctcgcccgcaccctcctggaacccggccgcgcgccgctgggcgattacctgctcaacctgtacggacccacggagaccaccgtctggtccaccgtcgcgcggatcaccgccgattccttggaggcgcacggcggcgccgtgcccacggggacgccgatcgcccgcaccgccgcctacgtgctcgacgccgcgctgcggcccgtgcccgacggagtgccgggcgagctgtacctggccggcgccgggctggcccggggctatctgggccggccgggaatgaccgccgagcggttcgtggcctgcccgttcggggagccgggggagcggatgtaccgcaccggcgacctcgcccgctggcgggccgacggcaacctggaacacctgggcaggaccgacgaccaggtcaaggtccgcgggttcaggatcgaactgggcgaggtggaaagagccctgacgcaggcccacggcgtcggccgggccgccgccgccgtccaccccgacgccgccggctccgcccgactggtcggctatctggtaccggccggcggcagcggcgcactcgacgagaaggccgtcgccgacgccgtgcgggcggtgctgcccgcgtacatggtcccctcggcgctggtggtgctggacggcggcctgccgctgaccgcgaacggcaagctggaccgggccgcgcttcccgcgcccgaggcgacgaccggccgcggccccggccgggcgccgcgcgggccgcgcgaggagatcctgtgcgggctcttcgccgacgtactgggcgtgcccgcggtcggcgtggacgacgacttcttcgccctgggcggccactccctgctcgccacccggctcatcgcccgggtccgcggcacactcggcgtcgaactcggcgtccgagaggtcttcgagacaccgaccgtggccggtctcgccgccgcgctctccgcggcgggcgaggccggaccccggctgcgccccgccgacccgcgccccgagcgcctgcccctgtcccacgcccagcgccgcctgtggttcgtccggcaactggaggggccgagtgccacctacaacgtcccgtgggcgctgcgcctgaccggtccgctggacgtggcggcgctgcgggccgcgctgggggacgtggtcgcccggcacgagagcctgcgcaccgtcttcgccgaggacgagcacggcccgcaccaggtcgtcctgtccgccgacggcccggccccgctcagcgggcccgtccggaccgacgaggacgcactgccccgcctgctgcgggaagcggccgaccacgccttccggctggacgccgaaccgccgctgcgcgcccacctgttcgccaccgcgccggaggaccacaccctgctcctggtcatgcaccacatcgccaccgacgcctggtcgcagcggccgttgatcgccgatctggccgcggcctacgccgcccgccacgccggccgggtcccgacgctgccgccgctgccggtcgcctacgccgactacgccctgtggcagcaggcccgcctgggcgacgaacgggagaaggacagcgcgctgtccgcccaactcgcctactggcgcgacgcgctggcgggctccccggaggagctcgcgctgcccgccgaccggccccggcccgccgtcccctcgcaccggggggacagcgtgcccctcaccgtcccgccggaactgcacgggcgggtggtggagttggcgcgggagttccgggcgacgccgttcatggtggtgcacgcggcgttggcggcgttgctgacgcggttgggcgcgggcacggacgtgccgatcggttcaccggtggccgggcgggtcgacgacgcgctggaggacctggtggggttcttcgtcaacacgctggtgctgcgcacggacacctcgggcgacccgaccttcggggagttgctggaacgcgtacgggccaccgacctgggggcctacgcccaccaggacctccccttcgaacgcctggtggagctccgcgacccggaacgctcgctggcccgccacccgctcttccaggtctcgctgaactacgacacggccgagacggcccgagcacgcgatgccgcaccggaactggacgggctgaccgtgagcgggcgaccgctcggcgtcaccacgtccaagttcgacctcaccttcgcgctcaccgagacccgcgcccacgacggcggccccgccggactgcgcggcgcgctggagtacagcaccgacctgttcgaccgtggcaccgccgagcgcctggcggagcggttcgcacgggtcctccaggccgcggtggccgcccccggcaccaggctcgaccagatcgacgtgctgctgccgggcgaacgcgcgctcctggagggcgagtggagcaggcccgagcccggacccgtcgcccccacggacgacgcccgcttcccggacctcttcgaggcgcaggccgcccgcaccccgcacgcccccgccgtccgcgacggtgaccgggagctctcctacgccgagctgaacgaccgggccaaccggctggcccggttcctcgccgctcgcggagcgggccccgaggacaccgtcgccgtcctgctgccgcgcggccccgagctgatcaccgccctggtggccgtccagaaggccggggccgcctacgtccccatggacgccgagctgcccgccgagcggatcgcccacatgctggagaacgcccgcccggtgctcgtcctcgcccacaccgcaacccaggacgccctcccggagggggccggccccgtggtccgcctcgacgccccggccatcgaggcggcgctcgccgggctcgacggcggcgactgcaccgacgccgaccgccgcgcaccggccacgcaccacgacccggcctacgtcgtctacacctccgggtccaccggtacgcccaagggcgtcgtggtcgaacagcgctccctcgccgccttcctggtccgctcggccgcccggtaccgcggagccgccggaaccgcgctgctgcacggctcgccggccttcgacctcacggtcaccaccctgttcaccccgctgatcgccggaggctgcatcgtggtggcggacctcgacgctccggagcgggacgccccggcccgccccgacctgctcaaggtcactccctcccacctcgccctcctggacacgatcgcctcctgggcgacacccgcggccgacctggtcgtcgggggcgagcaactgaccgcgtcccgtctcgcccggctgcgccgggcacacccggacatgcgcgtcttcaacgactacggtcccaccgaagccaccgtgagctgcgccgacttcgtcctggaaccgggcgacgcaccgcccaccgacaccgtgccgatcggacgccccctggcgggacaccggctgttcgtcctggacgatcgcctgcgcccggtgcccgccaacgtccccggcgagctgtacgtcagcggcgtcggggtggcccggggctatctgggccggccgggaatgaccgccgagcggttcgtggcctgcccgttcggggagccgggggagcggatgtaccgcaccggcgacctcgcccgccggcgggccgacggaaacctggagtacctgggccgccgcgacggccaggtgaaggtgcgcggattccgcgtcgagacgggcgagatcgagaccgccctgctcgaccgcccggagatcggccaggccgccgtcgtcctgcgcggcgaacgcctcctcgcctacgtcgcggccccgccggagcggttcgacccggacgcgctccgccaggcgctcgcgtcccggctgccccggtacatggtccccgccgcgttcgtccggctggacgccctgccgctggctccgggaggcaagctcgaccaccgggcgctgcccgagccgccggcgcccgccgacgccccgcacgggagcaggccgccgcgcgacgcgtgggaaggcgtgctgtgcgaggcgttcggcgaggtgctggggatcgcggaggtcggggccgacgacgacttcttcgccctcggcggcgacagcatcggctccatccggctcgtcggccgggtgcgcgcggcgggcggccggatgaccgtccgcgacatcttcgaacagcgcacgcccgccgccctcgccggccgctcgcgccccggcggtccggcgaccgaggtactcggcggtcgcgggaccgggccggtggagccgacgccgatcagctcctggctggccgagctgggcggcgcggtcgacgggtacaaccagtccgtgctgctgcgcgtccccgccgaggccgacgcggccgtcgtgaccggcgccctccagacactgctggaccaccacgacgcgctgcggatgcgggccgaaccggaggacggtcactggcggatggagatcgccgaggcgggcgcggtggacgcggccaccgtgctggagcgggtggacgcggcgggcgccgatcaaggggagctggaccggctggtgcggacgcactgcgccgcggcccgtgaccggctcgccccgcagaagggctccgtcctgcgtgccgtctggttcgacggcgggccacgggagccgggacacctcgcgctcgtcgcccaccacctcgtcgtggacggagtctcctggcgcatcctcaccgccgacctcggcagcgcgtggcaggccctcgccgagggccgggaaccccacctcgacccggtgggcaccccgctgaggatctgggcccggcacctggcggagctggccgccgacccgcgccgcgccgagcggtgcgcccactgggaggagcagtcgccgcggccctgggagaccggcggtctcgaccccgccctcgacgaccggagcaccgaggaggccctttccctgaccctcccggccgccgccacccgcgccgtgctcggcccggtgcccgccgcgctcggcgtcggggtgagcgaagtcctgctcggaacgttcgccgccgccgtgcggcgccggcgtcccgcggaggccgcggacggcgtcacggtggacctggaaggccacggccgggaggaggacgtcgtccccggagcggacctctcccgcacggtcggctggttcaccgccgcccacccggtccgggtgcccgccgcgcggcccgacgaggaccggaccggcgcgctgcgggcgctggccgcgatcctggaccgggcgcccgacgccggcctcggctacggcctcctgcgctacctcaacccgcgcacccggcaacggctcgccgccctgcccgccccgcgctacggcttcaactacctgggcagattcggtggttcgggagaggaccgggacgcggacgaccggacgtcgaactggtcgccggtggccgccgggctcgccggccagcccgcccagctgcccctggcccacgagatcgaggtcaccgcggtcgccgtcgaggggcccgagggcccgcgtctgatcgccacctggtcctgggccggccggctccaccgggagcgggacgtccgcgaactggccgaactctggttccgcgagctggaggaactcgcgtccgccgaaccgcccccggccggccccgcgcccctgtccgacccgccccccctggtcgaactcaccgacaccgaactcgaccagctcgaagcagagtggaaggccggctga

SEQ ID NO: 13 - protein, 2384 aa, Streptomyces fradiae
MRGSLQDVLPLSPLQEGLLFHSEYVGDEAVDVYTVQTEVELRGPLDVPALRAAAEAVLRRHDNLRAGFATRALKDPVQFVPREVELPWEEADLRAADDPDAEAARRLEEHRWRRFRPSKPPLVRFLLLRTAHDRHRFALTNHHILLDGWSMPMLLRELMLLYRTGGDASALPPVRRYRDYLAWLGGRDRGTAREAWRAALAGLEAPTLIAPRADRAAEAPTWLDFTLSETASAGLSAAARAAGLTLNTVVQGLWALTLARTTGSQDVVYGVVVSGRPPELDGVESMIGLFANTVPLRARMPVDEPLTDFLRRLQREQSALLDHQHLRLADIQRLAGQGELFDSVMAFENYPDGPADEPSGASADTPGHVRVVASRMRDAMHYPLGLLASPGTRMRFRLGHRPSAVTPRLAAALRDRLLRLVDAFLATPHLPLGRFDVLDDAERALVLDTFNDTAHEVEDTTAVELFLRQAARTPARIAVETADRSVDYARLADRSGRLARLLAEHGARAERFVALVLPRSPELVETALAVWQTGAAYVPVDPAHPADRMARLLREADPVLTVTTADLADRLPAGLPLLVLDGPSTAAALQALPGGPLTASELPAPVDPRNAAYALYTSGSTGRPKGVVATHRSLVGYLLRGSAQYPSDGRSLVHSPVSFDLTVGALYVPLISGGTVRLASLDDEPVLRPGETPPDFVKVTPSHLPVLEGLPGEVSPTGAITFGGEQLTGRHLRRWRADHPDVTVYNVYGPTETTVNCSEHRIAPRDPVGDGPVPIGRPLWNTRLFVLGPGLAPVPVGVPGELYVAGAGLTRGYLRDPGRTAERFVACPYAAGQRMYRTGDLVRWNEDGLLEYLGRVDDQISLRGFRVEPGEVEAALAAHPAVRRAAVVLREDTPGDARLVAYAVPAEPEGARSTPPSPLPTEQILEHLRRTLPPYMVPAHLVELPALPVTPHGKIDRAALPEPSVAGAPAGGAPRSPREEILCGIFAEVLRRPRVSIDDDFFALGGHSLLATRLASRVRAALDTELPVRRLFEHPTVRSLSALLDPDAGRRPAVTPARRPEHVPLSFSQQRLWIMHRLTGPDATYNIHRALRLDGDLDVPALEAALHDVTERHETLRTVFPEGPEGPYQKVLPARREDGTLTVLPVADREVDRTLAELAAHRFDLESEPPKRAWLLESGPRSRVLVLVLHHIASDGWSGRRLLRDLFTAYTARRAGRAPQWRPLPVQYADYALWQRRHLGDPADPASPAAVQGEYWEKQLAGLPEELRLPADRPRPARPTRTGGQVWLTLPATAHAAVAELARTSRASVFMVVQAAVAAFLTRMGAGEDIPIGAPVAGRTDEAVEELVGFFVSTLVLRTDTSGDPSFTELVGRVRETALAAYAHQDLPFEYVVERLSPTRSLGRHPLFQVALSCNNTEEQLGRQGAPPPGLSVTPHQVDAARSKFDLMFTFLENHGEDGQPTGIETALEYSADLFDRETAQSLLDRFARMLAIWAAEPAAAIGARELLAADERHTVVTAWNATRRADLVATLPRMFEEQVARTPHATALEHAGHHLTYAELNARANRLARVLVRRGIRPEHRVAILMPRSVEQITALLAITKAGGAAVPVDPGHPGQRIAFMLRDSACALILADHPHAAGREEIAGVPVLVPADEPAPERATDLADGDRNAPLTAGHAAYVVYTSGSTGRPKGVVTEHRGLLSLATAQRERYPVGPGSRVLQLASPSFDGAVLELLMALTTGGTLVLPDGPLLAGQPLADMLAEHRISHAFIPPAVLSGLPSEGLEGLRCLVVGGEAVTAPLTDRWAPGRRMLNIYGPTETTAVTLTSEALTPGGPPPAIGTPVPNTRAHVLDDRLRPVPPGVTGELYLAGASLARGYGRRPALTASRYVGCPFGAPGERMYRTGDLARLDREGRVHHMGRTDEQIKLRGFRVEPGEIRARLTEHPAVREAAVVLRDDGPGGRALVAYAVPADGPPRPTAAQLRAHLNALLPPYMVPAAFLVLDALPTTPNGKLDREALPAPQPHAEETGRPPRDEREAALCEVFAEVLERTSLGADDGFFENGGHSLLAVRLVARVRERLGVPLAARDLFEAPTPAALAERLARGAERRAPAPLLTLRGRGDRPPLFCVHPAVGLGWAYASLLPWLPADVPLHALQARTPADGAGLPGSVEEMAEDYVRLIRRVRPHGPYRLLGWSLGAHVAHTAAALLERDGQRVDLLAMLDAYPPHRTGDPGGRAEESEAEIVAANLRESGFAWDEDEQRAGRFPLERFRAHLRRVDSSLGHLDDAELTAAKDVYVNNVRLMRSFTPGRVRCGIVLMTAERTRSLDPAAWEPHTEGGVEVHRLDASHMSMLTEPASVAAAGRLLTHRLESLRGATTKKREV

SEQ ID NO: 14 - DNA, 7155 bp, Streptomyces fradiae
atgcgcggatccctacaggacgtcctgcccctctccccgctgcaggagggcctcctcttccacagcgaatacgtcggggacgaggccgtcgacgtctacaccgtccagaccgaggtggagctgcggggaccgctggacgtcccggcgctgcgcgcggcggccgaggccgtgctccgccgccacgacaacctgcgggccggcttcgcgacccgcgccctgaaggacccggtgcagttcgtcccccgcgaggtcgaactcccctgggaggaggccgacctgcgcgcggccgacgacccggacgcggaggcggcccgccgactggaggaacaccgctggcgccgtttcaggccctccaagccgcccctggtgcggttcctgctgctgcggacggcccacgaccgccaccgtttcgctctcaccaaccaccacatcctgctggacggttggtcgatgccgatgctgctgcgcgagctcatgctgctctaccgcaccgggggcgacgcctccgccctgccgccggtgcgccgctaccgggactacctggcctggctggggggccgcgaccgcgggaccgcacgggaggcctggcgcgccgctctggcgggtctggaggcgcccaccctcatcgccccgcgggccgaccgggccgcggaggcgccgacgtggctcgacttcacgctgtcggagaccgcctccgccggtctctccgcggccgcgcgagccgccggcctcacgctcaacacggtcgtgcaagggctgtgggccctgaccctggcacgcaccaccggcagccaggacgtggtgtacggggtggtcgtctccggacgtccgccggagctggacggcgtcgagtccatgatcggcctgttcgcgaacacggtcccgctgcgggcccggatgcccgtcgacgaacccctgacggatttcctgcggcggctgcagcgcgagcagagcgcgctcctggaccatcagcacctacggctggccgacatccagcggctggccggccagggcgagttgttcgattccgtgatggcgttcgagaactacccggacggccccgccgacgagccctccggcgcttccgccgacacgccgggacacgtccgcgtggtggcctcccggatgcgcgacgccatgcactacccgctcggcctcctggcgtcccccggaactcggatgcgcttccgcctcggccaccggcccagcgcggtcacgccgcgcctggccgccgccctgcgcgaccgcctgctgcggctcgtcgacgccttcctcgccaccccgcacctgccgctgggcaggttcgacgtcctcgacgacgccgaacgcgccctggtactggacacgttcaacgacaccgcgcacgaggtcgaggacaccaccgccgtcgagctgttcctccggcaggccgcccgcacccccgcccggatcgccgtggagacggccgaccgctccgtcgactacgcccggctcgccgaccgctccggccgcctggcccgcctgctggcggagcacggggcgcgggccgagcggttcgtcgccctcgtgctgccgcgctcgcccgaactggtcgaaaccgcgctcgccgtgtggcagaccggagccgcctacgtcccggtggaccccgcccacccggccgaccggatggcccggctgctgcgggaggccgaccccgtcctcaccgtcaccaccgccgacctggccgaccggctgccggccgggctccctctgctggtcctggacggcccgagcaccgccgccgccctccaggccctgcccggcggcccgctgaccgcgagtgagctccccgcgcccgtggacccccggaacgccgcctacgcgctctacacctccgggtccaccggccgccccaagggcgtggtcgccacccaccgctccctcgtcggctacctgctgcgcggctcggcccagtacccgtccgacggacgctccctggtgcactcgccggtctccttcgacctcaccgtcggcgccctgtacgtcccgctgatcagcggcggcaccgtgcgcctcgcctccctggacgacgaaccggtcctgcgccccggcgagacgccccccgacttcgtgaaggtgacccccagccacctgcccgtcctcgaagggctgccgggcgaggtcagcccgaccggggcgatcaccttcggcggcgaacagctcaccggccgccacctgcggcgctggcgcgccgaccacccggacgtcaccgtctacaacgtctacgggcccaccgagacgaccgtcaactgctccgagcaccgcatcgccccccgtgacccggtcggcgacgggccggtccccatcggacggccgctgtggaacacccgcctgttcgtcctgggccccggcctcgccccggtgccggtcggcgtgccgggcgagctgtacgtcgccggcgccggcctgacccgcggctacctccgcgatccgggcaggaccgccgagcgcttcgtcgcctgcccctacgccgccgggcaacggatgtaccgaaccggcgacctcgtccgctggaacgaggacgggctgctggagtacctgggcagggtggacgaccagatcagcctgcgcggcttccgggtggagcccggcgaggtggaggcggcgctggcggcccaccccgcggtccgccgcgccgcggtggtgctgcgggaggacacgcccggcgacgcccggctggtcgcctacgccgtccccgccgagccggaaggagcgcggagcacgccgccgtccccgctccccaccgagcagatcctggaacacctgcgccggaccctgccgccctacatggtccccgcgcacctcgtggaactgcccgcgctgcccgtcacgccccacggcaagatcgaccgggccgcgctgccggaaccctccgtcgccggcgccccggccggaggagcgccccgctccccccgggaggagatcctgtgcggcatcttcgccgaggtgctgcggcgcccgcgggtctccatcgacgacgacttcttcgccctgggcgggcactccctgctggccacccggctggccagcagggtgcgggcggccctggacacggagctgccggtgcgccgcctcttcgaacaccccacggtgcgctccctgtccgcactgctggaccccgacgccggcaggcgccctgcggtgacgcccgcacggcgacctgagcacgtcccgctctccttctcccagcagcggctgtggatcatgcaccggctcaccggccccgacgccacgtataacatccaccgggccctgcggctcgacggcgacctcgacgtcccggcgctggaggccgcgctgcacgacgtgaccgaacggcacgagacgctgcgcaccgtcttccccgagggccccgagggcccgtaccagaaggtcctcccggcccgacgggaggacgggaccctcaccgtcctcccggtcgccgaccgggaggtcgaccgcaccctcgccgagctggcggcccaccgcttcgacctggagtccgaaccgccgaagcgcgcctggctcctggagagcggtccgcgcagccgggtcctcgtcctggtgctccaccacatcgccagcgacggctggtcgggcaggcggctcctgcgcgacctgttcaccgcctacaccgcgcgccgcgcgggccgggcgccccaatggcgaccgctgccggtgcagtacgcggactacgccctgtggcagcggcgccacctcggcgaccccgcggaccccgccagtcccgccgccgtccaaggggagtactgggagaagcagttggccggactccccgaggaactgcggctgcccgccgaccggccgcgcccggcgcgcccgacccgcaccggcggccaggtgtggctgacgctcccggcgacggcccacgccgccgtggccgagctggccagaaccagccgggccagcgtgttcatggtcgtccaagccgccgtggccgccttcctcacccgcatgggcgccggggaggacatccccatcggcgccccggtcgccgggcgcaccgacgaagcggtggaggaactggtcggattcttcgtcagcaccctggtcctgcggaccgacacctccggtgacccctcgttcaccgaactcgtcggccgggtccgggaaaccgcgctggccgcctacgcccaccaggacctgcccttcgagtacgtggtggagcggctcagcccgacccggtccctcggccggcaccccctcttccaggtcgccctgtcctgcaacaacaccgaggagcagctgggccgccagggcgccccgccccccgggctctccgtcacaccgcaccaggtggacgccgcccgctcgaagttcgacctgatgttcaccttcctggagaaccacggcgaggacggccagcccacgggcatcgagaccgccctcgaatacagcgccgacctgttcgaccgggagaccgcgcagagcctcctcgaccgcttcgcccggatgctggcgatctgggcggcggaaccggccgccgccatcggcgctcgcgaactcctggcggccgacgagcggcacacggtggtcaccgcgtggaacgccacccggcgcgcggacctggtcgcgacactcccgcggatgttcgaggagcaggtcgcccgcaccccgcacgccacagccctcgaacacgccggccaccacctgacgtacgccgaactcaacgcccgagccaaccggttggccagagtgctggtgcgccgcggcatccgccccgaacaccgcgtcgccatcctgatgccgcgctccgtcgagcagatcaccgccctgctggccatcaccaaggccggcggcgccgccgtaccggtcgatcccggccaccccggacaacgcatcgccttcatgctgcgcgacagcgcctgcgccctgatcctggcggaccacccgcacgcggcgggacgtgaggagatcgccggcgtcccggtcctcgtccccgccgacgaaccggccccggaacgggccaccgacctcgccgacggcgaccgcaacgcccccctcaccgccggccacgccgcctacgtcgtctacacctccggttccacgggccgccccaagggcgtggtgaccgaacaccgcggcctgctgtcactggccacggcacagcgtgagcgatacccggtggggcccggcagccgggtgctgcaactcgcctcaccgtccttcgacggcgccgtactggaactgctcatggccctcaccaccggaggaaccctcgtcctgcccgacgggcccctcctcgccgggcaaccgctcgccgacatgctggccgagcaccgcatcagccacgccttcatccccccggcggtgctgagcggccttccctccgaagggctggagggcctgcgctgcctcgtcgtcggcggcgaggcggtcaccgcgcccctcacggaccgctgggcgcccggccgtcgcatgctcaacatctacggccccaccgagaccaccgccgtcaccctgaccagcgaagccctgacccccggcggcccaccgcccgccatcggcacccccgtacccaacaccagggcccacgtgctcgacgaccggctgcgccccgtcccgcccggcgtgacgggcgagctgtacctggccggcgcgtcactggcgcgcggctacggccgccgcccggcgctcaccgccagccgctacgtcggctgcccgttcggagcgccgggggagcggatgtaccgcaccggcgacctggcgcgcctggaccgggagggccgcgtccaccacatgggccgcaccgacgagcagatcaagctgcgcggcttccgcgtcgagcccggtgagatccgggcccggctcaccgagcatcccgccgtgcgggaggcggcggtcgtcctgcgcgacgacgggccgggcggacgcgcgctggtggcctacgcggtaccggccgacggcccgccccgccccaccgcggcccagctccgcgcacacctgaacgccctcctcccgccctacatggtgcccgccgccttcctggtgctggacgcgctgccgaccacccccaacggcaagctcgaccgggaggccctgcccgccccgcaaccgcacgccgaggagaccggccgtccgccgcgcgacgaacgcgaggccgccctgtgcgaggtgttcgccgaggtcctggagcgcacgtcgctcggcgccgacgacggcttcttcgagaacgggggacactcgctgctcgccgtccggctggtcgccagggtccgcgagcgcctgggcgtgcccctggccgcacgggacctgttcgaggctcccaccccggccgccctggcggagcgcctggcccgcggcgccgaacgccgcgccccggcgcccctgctcaccctgcggggccgcggcgaccggccccccttgttctgcgtccacccggccgtcggcctgggatgggcgtacgcgagcctcctgccgtggctcccggccgacgtccccctccacgcgctgcaggcccgcacgcccgcggacggcgccggtctgccggggagcgtcgaggagatggccgaggactacgtccggctgatccgccgcgtccgcccccacggcccctaccggctgctcggctggtcgctgggagcccacgtggcccacaccgcggcggccctgctggagcgcgacggacagcgggtggacctgctcgccatgctggacgcctatcctccccaccgcaccggggaccccggcggacgggccgaggagtccgaggccgagatcgtggcggccaacctgcgggagtcggggttcgcgtgggacgaggacgagcagcgcgcgggacgcttcccgctggagcgcttccgcgcccacctgcgccgggtggacagctcgctcggccacctcgacgacgccgaactgacggcggccaaggacgtctacgtcaacaacgtccggctcatgcgctccttcacccccggccgtgtccggtgcgggatcgtcctgatgaccgcggaacgcacccgcagcctcgatccggcggcgtgggagccgcacaccgaaggaggcgtcgaggtgcaccggctggacgcctcccacatgtccatgctgaccgaaccggcgtcggtcgcggcagccggccgtctcctgacccaccgactggagtccctgcggggagccaccacgaagaaacgagaggtatga

SEQ ID NO: 15 - protein, 78 aa, Streptomyces fradiae
MTNPFDDTEGVFHVLVNDENQHSLWPHFVEIPDGWRAVVRERPRQECLDYIEANWTDMRPQSLIDAMEAHEKSEGAIR

SEQ ID NO: 16 - DNA, 237 bp, Streptomyces fradiae
atgaccaaccccttcgacgacaccgagggcgtcttccacgtcctggtcaacgacgagaaccagcactcgctgtggccccacttcgtcgagatccccgacggctggcgggccgtggtgcgcgagcgtccgcgccaggagtgcctggactacatcgaggcgaactggaccgacatgcgcccgcagagcctcatcgacgccatggaggcacacgagaagtccgagggcgcgatccggtga

SEQ ID NO: 17 - DNA, 8321 bp, Streptomyces fradiae
ccctccggccccacccccggtcctggagaccgccgacgaactgcgaggaagtccggatgctggcacggatcaatgggatcgacctggatcacgaacgcagaggcagtggttcccccgtcctcctgatcatggggagcggcgccgccggaacgggctggcatttgcaccaggtgcccgcgctggtcgccgccggtttcgaggccgtcaccttcaccaaccggggcatcacccccagcggcgggggccccggtttcacccttcaggacatggccgccgacaccatcggcctgatcgaacacctcgggctgggcccgtgcgcggtcgtggggacgtccctgggggccagggtcgcgtgcgaggtcgcccgtacccgccccgacctggtctcccggtgcgtcctcatggcgccgcgagcacgcgcggaccggacgagggccgccgcgaccgaggcggagatcgccctggccgacagcggcgtcaccgtcccgccccgctaccgggcggtggtgcgggccatgcagaacctctcaccccggacgctcgcggacgacgaacggatcgccgactggctcgacctcttcgaactggcggcggccgccggccccggtgcccgcacccagctggagatcagcgccgtctaccaccgcgaggaggacctggcccggatcaccgccccctgccgggtgatcgccttcgccgacgacatcgtggcgccggcgcatctggccaaggagatcgccgacgccctgcccgaggccgactaccacgtggtgcccgactgcggccactacggctacctcgaacaacccgaccgggtcaaccggctcatcacccaattcctcgccgcatgaaagagccccgcatggaaccgaccaccgcctggcggcccgccgtgatcagtccggacagccacgcgctgcccgccaccgccgacgccctggcgggcctgctccaggactccgcccgcaccgacgaactcctggccgcccacaaagtgctgttcctcagcggcttcggagtgggcccgctggagctggagaagatcatgccgctcctgctccccgaccgcctgccctacgtcttcggcaactccccgcgcaccaaggtcggacacaacgtgtacacctcgacggagtacccggcggaattcaccatctcgatgcacagcgagatgtcgtacgccgcgcgatggccggcccggctgctcttctactgcgagcgggcggccgacaccggcggcgcgaccccggtggtggacaacgccgcctggtaccgggcactggacaaggacgtccgcgacgcctacgcgggcggcctgcgctacacccagaacctccacggaggacgcgggctcggcaagagctggcaggacaccttcgagacggaggaccgctccgaggtcgaggagtacctctcccgcaccggcgccacctggcagtggaacgcccgcaacggactgcgcgtcagccacgtacgacccgcgacgatcgaacaccccgccaccggcgagcggctgtggttcaaccagagcgaccagtggcaccccgccacgctcggcggcgaggccgccgcgctgatggagctgctgcccccggaggaactgccccagtcggtcgccttcgccgacggctccccgattccggccgagtacgcgcgccaggtccgcgaccgcggactggaacacgccgtggacaacgactggcgccccggcgacctcatgctcgtcgacaacgtccaggcggcccacggccgcaggcccttcaccggcgaccgccgcatcctggtcgccatgtcggaccacggacgcccccaccgccccggacagccgccgcgtcccccgcaggaaggccaccgatgaccatcgccctcgccgacgtggaagggctcaaccagcacgagaccgagttcctctacgacgagatcttcacccgccgcgcctacctgcccgaggccctgcacctgcccgaggcccccgtggtcttcgacgtcggggccaacatcggcatgttcaccctcttcgtacgctcggaacgacccggtgccacggtccactccttcgaaccggtccccccggtgcgcgacatcctgtgccgcaaccgggagcgccacgcggtggcggggctcgtccatccctacggcctcgccgaggcggaacaggaagtcgagttcacccactatccgggctactcgaccatgtccacgcgcagcaccctggcggacaccgaggcggaacgggccttcgtccgggggcaggtgcggaccgccgacctgcccgaggccgagcggatgctggacgaactcctcgccttccggttcagggaggagaaggtgacctgccggctccgccccctctccgccgtcctcgacgagcatcccgtcgaccggatcgacctgctgaagatcgacgtccagcgcggtgagcgggaggtgctgcgaggactggaggaccggcactggccactggtccgccagatcgccatggaggtgcacgacagccccggcggcagcaccgccggccggctgcgagcggtggccgacgagctggagcggcgcgggttcgacgtcctgaccgagcaggaggaccggtacgcgggcaccgaccgccacagcgtgttcgccgtcgcggaaccgcgtcgcggctgagccacgtccccgcccggccgcccaccgcagaaccgaatcgaacggtcccccacctcccggagaaacagcatggaacccgagaacaccttcaccctgtccgaagccgaacgcgacgacgtggccgccttggcccaggagttgacgcgcgcgcgccccggcctggtggacgagagggaatggctcgaccggtgccgcaccctctcctgccacctgcccgcccgcctccaggaccggctccgcgccttccgccacgaccccggccccaccggcaggctgctcctgcgcaaccttcccgccgccgacagcgtgccggccaccccgcgggagcccgactccgtggagcgcagggcgacgctgagcgcctccgtgctgtgcgccctgtccatggaactcggtgacgtcatcgcctaccgcaacgagaagcagggcgcgctcgtgcagaacgtggtgccggtgcccggccgggagggccagcagtccaacgccggctccgtcccgctggagatgcacaccgagaacgccttccacccccaccgccccgactacgtgggcctgttctgcgtccgcagcgaccacgaccgggccgcgggactgcgggtcgcctccgtccgcgccgtgatggaccacctggacgcggggacacgcgagatgctgcggcagcccctgttcaccaccgagccgcccccttccttcgggcggccggacagcgggaccaagccgcacgccgtgctcaccggcgacgccgaggacccggacatccgggtggacttccacgccacccacaccagcgatccctggggcaggcaggccatggaggccctggcggaggccgtccgcaccgtctccgaggaactggtcctggaaccggccgacctggtgtacgtggacaaccgcgtcgctctgcacggacgcacggccttcgtcccccgctacgacggacaggaccgctggctccagcgcgccttcgtccacctggaccaccggcggtcccgcgccgcacgcgcgcaccattcgcgtgtactgagctgatggcggtggaccaggtgattcacgccaccggcctgcacaagcgcttcgccgcggtccaggccctcgccggcgtggacctgacggtggcgcgcggggagatcatgggccttctgggccacaacggggcggggaagaccaccctcgtcaacgtcctgtccaccctcacgccccccacctcgggcaccgcgtcggtcgccggtttcgacgtggtcggccgccccgacgaggtgcgtcggcgcatcggcgtcaccgggcagttcgccgcgctcgacgaggagctgtccggttacgacaacctcgtcctggtggcccgcttgtgcggagcctccaaggcacaggcggtcggccgggcggacgagttgctggagatgttcggcctccgtgccttcgcacggcgcagggcggtgtcgtactcgggcgggatgcgccgccggctggatctggcgctcgggctggccggccgtcccgacgtcctgttcctcgacgagccgtccgtggggttggacctgcccagccgtctcggcctgtgggagatggtgcaggggctcgcgcgggacggcacggcggtcctgctgacgacgcagtacctggaggaggccgatcggctcgccgaccggatcaccgtcctgggggcgggccgggttctggtgtcgggtaccgcggtggagctgaaggcacgggccggtcgcgggtccatctcgctgcgggtcggaccccagggcgacaggaccgtcgccgccgaggccctgcaccgggccggcttcccgtcgggcgtggacgacgggcgcggtgagctgaccgtgccggcgggggattcggcggacctggccgtggtgatccgggtgctggacgccgtgggacagaacgtcacggagatccgctacgcggagccctccctcgacgacgtctacctcgccttcaccgccacggcccccgacgcccccgctccggcgacgggagccctcagccaccctcccgcccccgctccggcgcgtatcgcccaccgcaccaccctcccggcggccgaacgacgcaccggcgacacctcggagaattcgtgaacgcacctggaacgatgacgccctcggccgagcccgcgacgcgggagcgggcaccgtgctggagaccggcgggcagggccgcacaactgcgggtgctcaccgcacgccagatccgtctggtctacgccgaccgcagggtggtgctgttcagcgtggcgcagccggtggtgatgctgctgctgatcagccaggtcttcggcagcctcgcggaccgctcgatcctgccgcgcggggtgacctacatcgagttcctgctgcccgctctcctcgtcaccaccgggatcggcacctcgcagtccgcgggggtgggactggtgcgggacatggagggcggcatggtgcgccgcttccgcgtcctgccgttgtcactgccgctggtgctggtcgcgcgttcgatcgcggatctgacgcgctcgggaatgcaactgctcgtcctggtcgtcgcgggccacctgctgttcggctaccgggccgggggaggagcggtgggactggtggcggcgttgtcgctgtccacggtggtgatctggtcgctgatctggatcttcatcgcgctcgccacgtggctgcgaaaggtggaggtgctctccagcatcggattcttcgtcaacttcccgctgatgttcgcttccagcgcgttcgtaccggtcgacgtcctgcccggttggctggcggccgtcgccaccgtcaatccggtgagtcacgcggtggaggcgtcgcggagccttgccctgggagagcaggccggaagcgaggtgaccgcggcgctgtgcggggccctgggcctgctggtgacgatgacggtcctcgccgcgcgcgctgtccgccgaccccccgacgagtgacgtgacgacacatcgacggatcctgtcgtcccgggcgagcgacgtcggacgacgcgacgcccggtcacgagctgcggcggcggtgcctgcgccgccaccacacggccgcgagtgtgaaggcgcccgcgacgcccagcagggaccacaagatggtggagagcacgctctcggcctcgcgcagggaggccgagaccagcgttcccgcggacacgtacagcgcggaccacatcgcggctccggcgagggaggcgggcaggaagcggcggtagcgcacggagccgaccccggcggtcgcgggggtgagggtgcgcaccacgggcagcagccgggtcaggaagacggcgcgcgccccgtgccggtggcagagatcctgcgcgcggtcccaatggtgctgccccatccgccgcaccagccgcgtctcccgcatccgctgcccgtagcggatgccgaggaagtagccgatgtggtcgccggccgagctgctgagcgtgacgacgaggaaaagggccagcagcgggcgcgtcccctccgttccggcgctcagggccagcaccgcgacctcgccggggacgaccatgccggcaccgaggccggactccgcgaacgcgaacgcggaggccagggcgaatctggcgaccgggctcatgtccgacaccgctgtcagcacatcgttcatccacgacatggcagccccgccccgcctctcctcgctcgtggagccctcccggcggcgcccctgggattcccacgcccctcttccgagaacacaccgaagggaacagggaaacgacttcccggtgtcaccggacgcatacccggccggccggtgcggtcgcccggccgcctgaaaaggacgaagggagaccaacgtaccagggaaccgccggacgacttcttccttccggccacgaccacccccgcgacggccccgccgatcgtcttcggcgaccgtctccgacgacgggggagaggagattcgtcgaccggatccgaccggatccgaccggaaggggaatgtgagggaacctccgtccgaagcagaggtgaaaaacaaaaaccgccaaccatcacgacgcgaagcgaccaccccgcagccggtccgacgcgcgaccgaccccgaccctccgacggcattcctccgatatgggtgaattcggcccgcaggaatccctgcccgccgtcggacgggaattgctgaggccgaatcccggcggaagcaccgcgcctttacccggagttcgcgccgccggcagggaaccggcacggcgcgccccggggcaggacgctccctcgtgagcactcttgacgcccgatcggcgccctgaaagggtgcgacggtgaaactgcggaccggactggccgagcgccggtgctctccccgaactccgctcggcgcactccggtgcggaccgatggaataacgggccgcccgtggcttgcgaaaggtgaaaaccctgtatacggaacgaccagtcgtccatgacgacattcatcgactgaccggattggtggaaatgcaggcggatgcaccggcgggaacaaaaacaggaacagaaacctacttaccgtccctgagtctcgaagactatctgcgcgacacggttccggcccacccggtcctgaaatcgtccgtggatttcggccgcccaggctctgatgaagcgctcagagcactggccgcgacgaccacggaattcgattccgacgagaccggacgcggcgacacctatcgcagggcccagcaggacccctccgtccgctggaggggaatgcgacaactgctcgaactggccgcgccctcccgcgccccctccgacacggccgccccccgcaccgtcctcgacgttctgggcggggacggaaccatcgcccgcgccgtccacgaccacgcccgcgagctgtgggaccgcccgcacatcctcaccggtgacctctcgggggacatggtcgaacgcgccctcgcccagggcctggccgccatccgacaggccgcggaccatctcttcctggccgacggcaccatggacgcggcactgctcgcctacggcacccaccacatcgcgccgcaggagaggctcgccgccgtcaccgaggccctgcgcgtcgtcaaggacggcggccacgtggtcctgcacgacttcgacgacgccagccccatggcacgcttcttcaccgacatcgtccacccccacaccacagccggccacgactaccgccacttctcccgcgaccttctggccgaactcttcgccgaggcgggcacaccggcccgcgtcgtcgacctgtacgacccactcgtagtccgcggcaccaccgaggaggaggcgcgccgccgcatgtgcgcgtacgtggccgacatgtacggagtcggcgcgttcttcgccaccctgggcggaaccgacgcgtgctggcgactcctggaggagtacttccagcacgacacctacctgtcgaccctgcccgagcagaccgacttcaccaccgcgccgatcgtctaccgctccgagggcgccttcatcgccgagataccccgcgcggccatcgtcgccgtctcccacaagccacccacctgacccccgcttccggaccccggggaccggcgcccccaccctcctgggactgcccgcagaggagtgggggccggtgatcgcgagccctgtccggcaggagagccgggcctggcagtccggagtccgaggacggcgatgttccggcggagcggcgtcggcagtgacgcgcggtc

SEQ ID NO: 18 - protein, 264 aa, Streptomyces fradiae
MLARINGIDLDHERRGSGSPVLLIMGSGAAGTGWHLHQVPALVAAGFEAVTFTNRGITPSGGGPGFTLQDMAADTIGLIEHLGLGPCAVVGTSLGARVACEVARTRPDLVSRCVLMAPRARADRTRAAATEAEIALADSGVTVPPRYRAVVRAMQNLSPRTLADDERIADWLDLFELAAAAGPGARTQLEISAVYHREEDLARITAPCRVIAFADDIVAPAHLAKEIADALPEADYHVVPDCGHYGYLEQPDRVNRLITQFLAA

SEQ ID NO: 19 - DNA, 795 bp, Streptomyces fradiae
atgctggcacggatcaatgggatcgacctggatcacgaacgcagaggcagtggttcccccgtcctcctgatcatggggagcggcgccgccggaacgggctggcatttgcaccaggtgcccgcgctggtcgccgccggtttcgaggccgtcaccttcaccaaccggggcatcacccccagcggcgggggccccggtttcacccttcaggacatggccgccgacaccatcggcctgatcgaacacctcgggctgggcccgtgcgcggtcgtggggacgtccctgggggccagggtcgcgtgcgaggtcgcccgtacccgccccgacctggtctcccggtgcgtcctcatggcgccgcgagcacgcgcggaccggacgagggccgccgcgaccgaggcggagatcgccctggccgacagcggcgtcaccgtcccgccccgctaccgggcggtggtgcgggccatgcagaacctctcaccccggacgctcgcggacgacgaacggatcgccgactggctcgacctcttcgaactggcggcggccgccggccccggtgcccgcacccagctggagatcagcgccgtctaccaccgcgaggaggacctggcccggatcaccgccccctgccgggtgatcgccttcgccgacgacatcgtggcgccggcgcatctggccaaggagatcgccgacgccctgcccgaggccgactaccacgtggtgcccgactgcggccactacggctacctcgaacaacccgaccgggtcaaccggctcatcacccaattcctcgccgcatga

SEQ ID NO: 20 - protein, 331 aa, Streptomyces fradiae
MEPTTAWRPAVISPDSHALPATADALAGLLQDSARTDELLAAHKVLFLSGFGVGPLELEKIMPLLLPDRLPYVFGNSPRTKVGHNVYTSTEYPAEFTISMHSEMSYAARWPARLLFYCERAADTGGATPVVDNAAWYRALDKDVRDAYAGGLRYTQNLHGGRGLGKSWQDTFETEDRSEVEEYLSRTGATWQWNARNGLRVSHVRPATIEHPATGERLWFNQSDQWHPATLGGEAAALMELLPPEELPQSVAFADGSPIPAEYARQVRDRGLEHAVDNDWRPGDLMLVDNVQAAHGRRPFTGDRRILVAMSDHGRPHRPGQPPRPPQEGHR

SEQ ID NO: 21 - DNA, 996 bp, Streptomyces fradiae
atggaaccgaccaccgcctggcggcccgccgtgatcagtccggacagccacgcgctgcccgccaccgccgacgccctggcgggcctgctccaggactccgcccgcaccgacgaactcctggccgcccacaaagtgctgttcctcagcggcttcggagtgggcccgctggagctggagaagatcatgccgctcctgctccccgaccgcctgccctacgtcttcggcaactccccgcgcaccaaggtcggacacaacgtgtacacctcgacggagtacccggcggaattcaccatctcgatgcacagcgagatgtcgtacgccgcgcgatggccggcccggctgctcttctactgcgagcgggcggccgacaccggcggcgcgaccccggtggtggacaacgccgcctggtaccgggcactggacaaggacgtccgcgacgcctacgcgggcggcctgcgctacacccagaacctccacggaggacgcgggctcggcaagagctggcaggacaccttcgagacggaggaccgctccgaggtcgaggagtacctctcccgcaccggcgccacctggcagtggaacgcccgcaacggactgcgcgtcagccacgtacgacccgcgacgatcgaacaccccgccaccggcgagcggctgtggttcaaccagagcgaccagtggcaccccgccacgctcggcggcgaggccgccgcgctgatggagctgctgcccccggaggaactgccccagtcggtcgccttcgccgacggctccccgattccggccgagtacgcgcgccaggtccgcgaccgcggactggaacacgccgtggacaacgactggcgccccggcgacctcatgctcgtcgacaacgtccaggcggcccacggccgcaggcccttcaccggcgaccgccgcatcctggtcgccatgtcggaccacggacgcccccaccgccccggacagccgccgcgtcccccgcaggaaggccaccgatga

SEQ ID NO: 22 - protein, 262 aa, Streptomyces fradiae
MTIALADVEGLNQHETEFLYDEIFTRRAYLPEALHLPEAPVVFDVGANIGMFTLFVRSERPGATVHSFEPVPPVRDILCRNRERHAVAGLVHPYGLAEAEQEVEFTHYPGYSTMSTRSTLADTEAERAFVRGQVRTADLPEAERMLDELLAFRFREEKVTCRLRPLSAVLDEHPVDRIDLLKIDVQRGEREVLRGLEDRHWPLVRQIAMEVHDSPGGSTAGRLRAVADELERRGFDVLTEQEDRYAGTDRHSVFAVAEPRRG

SEQ ID NO: 23 - DNA, 789 bp, Streptomyces fradiae
atgaccatcgccctcgccgacgtggaagggctcaaccagcacgagaccgagttcctctacgacgagatcttcacccgccgcgcctacctgcccgaggccctgcacctgcccgaggcccccgtggtcttcgacgtcggggccaacatcggcatgttcaccctcttcgtacgctcggaacgacccggtgccacggtccactccttcgaaccggtccccccggtgcgcgacatcctgtgccgcaaccgggagcgccacgcggtggcggggctcgtccatccctacggcctcgccgaggcggaacaggaagtcgagttcacccactatccgggctactcgaccatgtccacgcgcagcaccctggcggacaccgaggcggaacgggccttcgtccgggggcaggtgcggaccgccgacctgcccgaggccgagcggatgctggacgaactcctcgccttccggttcagggaggagaaggtgacctgccggctccgccccctctccgccgtcctcgacgagcatcccgtcgaccggatcgacctgctgaagatcgacgtccagcgcggtgagcgggaggtgctgcgaggactggaggaccggcactggccactggtccgccagatcgccatggaggtgcacgacagccccggcggcagcaccgccggccggctgcgagcggtggccgacgagctggagcggcgcgggttcgacgtcctgaccgagcaggaggaccggtacgcgggcaccgaccgccacagcgtgttcgccgtcgcggaaccgcgtcgcggctga

SEQ ID NO: 24 - protein, 319 aa, Streptomyces fradiae
MEPENTFTLSEAERDDVAALAQELTRARPGLVDEREWLDRCRTLSCHLPARLQDRLRAFRHDPGPTGRLLLRNLPAADSVPATPREPDSVERRATLSASVLCALSMELGDVIAYRNEKQGALVQNVVPVPGREGQQSNAGSVPLEMHTENAFHPHRPDYVGLFCVRSDHDRAAGLRVASVRAVMDHLDAGTREMLRQPLFTTEPPPSFGRPDSGTKPHAVLTGDAEDPDIRVDFHATHTSDPWGRQAMEALAEAVRTVSEELVLEPADLVYVDNRVALHGRTAFVPRYDGQDRWLQRAFVHLDHRRSRAARAHHSRVLS

SEQ ID NO: 25 - DNA, 960 bp, Streptomyces fradiae
atggaacccgagaacaccttcaccctgtccgaagccgaacgcgacgacgtggccgccttggcccaggagttgacgcgcgcgcgccccggcctggtggacgagagggaatggctcgaccggtgccgcaccctctcctgccacctgcccgcccgcctccaggaccggctccgcgccttccgccacgaccccggccccaccggcaggctgctcctgcgcaaccttcccgccgccgacagcgtgccggccaccccgcgggagcccgactccgtggagcgcagggcgacgctgagcgcctccgtgctgtgcgccctgtccatggaactcggtgacgtcatcgcctaccgcaacgagaagcagggcgcgctcgtgcagaacgtggtgccggtgcccggccgggagggccagcagtccaacgccggctccgtcccgctggagatgcacaccgagaacgccttccacccccaccgccccgactacgtgggcctgttctgcgtccgcagcgaccacgaccgggccgcgggactgcgggtcgcctccgtccgcgccgtgatggaccacctggacgcggggacacgcgagatgctgcggcagcccctgttcaccaccgagccgcccccttccttcgggcggccggacagcgggaccaagccgcacgccgtgctcaccggcgacgccgaggacccggacatccgggtggacttccacgccacccacaccagcgatccctggggcaggcaggccatggaggccctggcggaggccgtccgcaccgtctccgaggaactggtcctggaaccggccgacctggtgtacgtggacaaccgcgtcgctctgcacggacgcacggccttcgtcccccgctacgacggacaggaccgctggctccagcgcgccttcgtccacctggaccaccggcggtcccgcgccgcacgcgcgcaccattcgcgtgtactgagctga

SEQ ID NO: 26 - protein, 353 aa, Streptomyces fradiae
MAVDQVIHATGLHKRFAAVQALAGVDLTVARGEIMGLLGHNGAGKTTLVNVLSTLTPPTSGTASVAGFDVVGRPDEVRRRIGVTGQFAALDEELSGYDNLVLVARLCGASKAQAVGRADELLEMFGLRAFARRRAVSYSGGMRRRLDLALGLAGRPDVLFLDEPSVGLDLPSRLGLWEMVQGLARDGTAVLLTTQYLEEADRLADRITVLGAGRVLVSGTAVELKARAGRGSISLRVGPQGDRTVAAEALHRAGFPSGVDDGRGELTVPAGDSADLAVVIRVLDAVGQNVTEIRYAEPSLDDVYLAFTATAPDAPAPATGALSHPPAPAPARIAHRTTLPAAERRTGDTSENS

SEQ ID NO: 27 - DNA, 1062 bp, Streptomyces fradiae
atggcggtggaccaggtgattcacgccaccggcctgcacaagcgcttcgccgcggtccaggccctcgccggcgtggacctgacggtggcgcgcggggagatcatgggccttctgggccacaacggggcggggaagaccaccctcgtcaacgtcctgtccaccctcacgccccccacctcgggcaccgcgtcggtcgccggtttcgacgtggtcggccgccccgacgaggtgcgtcggcgcatcggcgtcaccgggcagttcgccgcgctcgacgaggagctgtccggttacgacaacctcgtcctggtggcccgcttgtgcggagcctccaaggcacaggcggtcggccgggcggacgagttgctggagatgttcggcctccgtgccttcgcacggcgcagggcggtgtcgtactcgggcgggatgcgccgccggctggatctggcgctcgggctggccggccgtcccgacgtcctgttcctcgacgagccgtccgtggggttggacctgcccagccgtctcggcctgtgggagatggtgcaggggctcgcgcgggacggcacggcggtcctgctgacgacgcagtacctggaggaggccgatcggctcgccgaccggatcaccgtcctgggggcgggccgggttctggtgtcgggtaccgcggtggagctgaaggcacgggccggtcgcgggtccatctcgctgcgggtcggaccccagggcgacaggaccgtcgccgccgaggccctgcaccgggccggcttcccgtcgggcgtggacgacgggcgcggtgagctgaccgtgccggcgggggattcggcggacctggccgtggtgatccgggtgctggacgccgtgggacagaacgtcacggagatccgctacgcggagccctccctcgacgacgtctacctcgccttcaccgccacggcccccgacgcccccgctccggcgacgggagccctcagccaccctcccgcccccgctccggcgcgtatcgcccaccgcaccaccctcccggcggccgaacgacgcaccggcgacacctcggagaattcgtga

SEQ ID NO: 28 - protein, 282 aa, Streptomyces fradiae
VNAPGTMTPSAEPATRERAPCWRPAGRAAQLRVLTARQIRLVYADRRVVLFSVAQPVVMLLLISQVFGSLADRSILPRGVTYIEFLLPALLVTTGIGTSQSAGVGLVRDMEGGMVRRFRVLPLSLPLVLVARSIADLTRSGMQLLVLVVAGHLLFGYRAGGGAVGLVAALSLSTVVIWSLIWIFIALATWLRKVEVLSSIGFFVNFPLMFASSAFVPVDVLPGWLAAVATVNPVSHAVEASRSLALGEQAGSEVTAALCGALGLLVTMTVLAARAVRRPPDE

SEQ ID NO: 29 - DNA, 849 bp, Streptomyces fradiae
gtgaacgcacctggaacgatgacgccctcggccgagcccgcgacgcgggagcgggcaccgtgctggagaccggcgggcagggccgcacaactgcgggtgctcaccgcacgccagatccgtctggtctacgccgaccgcagggtggtgctgttcagcgtggcgcagccggtggtgatgctgctgctgatcagccaggtcttcggcagcctcgcggaccgctcgatcctgccgcgcggggtgacctacatcgagttcctgctgcccgctctcctcgtcaccaccgggatcggcacctcgcagtccgcgggggtgggactggtgcgggacatggagggcggcatggtgcgccgcttccgcgtcctgccgttgtcactgccgctggtgctggtcgcgcgttcgatcgcggatctgacgcgctcgggaatgcaactgctcgtcctggtcgtcgcgggccacctgctgttcggctaccgggccgggggaggagcggtgggactggtggcggcgttgtcgctgtccacggtggtgatctggtcgctgatctggatcttcatcgcgctcgccacgtggctgcgaaaggtggaggtgctctccagcatcggattcttcgtcaacttcccgctgatgttcgcttccagcgcgttcgtaccggtcgacgtcctgcccggttggctggcggccgtcgccaccgtcaatccggtgagtcacgcggtggaggcgtcgcggagccttgccctgggagagcaggccggaagcgaggtgaccgcggcgctgtgcggggccctgggcctgctggtgacgatgacggtcctcgccgcgcgcgctgtccgccgaccccccgacgagtga

SEQ ID NO: 30 - protein, 206 aa, Streptomyces fradiae
MSWMNDVLTAVSDMSPVARFALASAFAFAESGLGAGMVVPGEVAVLALSAGTEGTRPLLALFLVVTLSSSAGDHIGYFLGIRYGQRMRETRLVRRMGQHHWDRAQDLCHRHGARAVFLTRLLPVVRTLTPATAGVGSVRYRRFLPASLAGAAMWSALYVSAGTLVSASLREAESVLSTILWSLLGVAGAFTLAAVWWRRRHRRRSS

SEQ ID NO: 31 - DNA, 621 bp, Streptomyces fradiae
atgtcgtggatgaacgatgtgctgacagcggtgtcggacatgagcccggtcgccagattcgccctggcctccgcgttcgcgttcgcggagtccggcctcggtgccggcatggtcgtccccggcgaggtcgcggtgctggccctgagcgccggaacggaggggacgcgcccgctgctggcccttttcctcgtcgtcacgctcagcagctcggccggcgaccacatcggctacttcctcggcatccgctacgggcagcggatgcgggagacgcggctggtgcggcggatggggcagcaccattgggaccgcgcgcaggatctctgccaccggcacggggcgcgcgccgtcttcctgacccggctgctgcccgtggtgcgcaccctcacccccgcgaccgccggggtcggctccgtgcgctaccgccgcttcctgcccgcctccctcgccggagccgcgatgtggtccgcgctgtacgtgtccgcgggaacgctggtctcggcctccctgcgcgaggccgagagcgtgctctccaccatcttgtggtccctgctgggcgtcgcgggcgccttcacactcgcggccgtgtggtggcggcgcaggcaccgccgccgcagctcgtga

SEQ ID NO: 32 - protein, 352 aa, Streptomyces fradiae
MQADAPAGTKTGTETYLPSLSLEDYLRDTVPAHPVLKSSVDFGRPGSDEALRALAATTTEFDSDETGRGDTYRRAQQDPSVRWRGMRQLLELAAPSRAPSDTAAPRTVLDVLGGDGTIARAVHDHARELWDRPHILTGDLSGDMVERALAQGLAAIRQAADHLFLADGTMDAALLAYGTHHIAPQERLAAVTEALRVVKDGGHVVLHDFDDASPMARFFTDIVHPHTTAGHDYRHFSRDLLAELFAEAGTPARVVDLYDPLVVRGTTEEEARRRMCAYVADMYGVGAFFATLGGTDACWRLLEEYFQHDTYLSTLPEQTDFTTAPIVYRSEGAFIAEIPRAAIVAVSHKPPT

SEQ ID NO: 33 - DNA, 1059 bp, Streptomyces fradiae
atgcaggcggatgcaccggcgggaacaaaaacaggaacagaaacctacttaccgtccctgagtctcgaagactatctgcgcgacacggttccggcccacccggtcctgaaatcgtccgtggatttcggccgcccaggctctgatgaagcgctcagagcactggccgcgacgaccacggaattcgattccgacgagaccggacgcggcgacacctatcgcagggcccagcaggacccctccgtccgctggaggggaatgcgacaactgctcgaactggccgcgccctcccgcgccccctccgacacggccgccccccgcaccgtcctcgacgttctgggcggggacggaaccatcgcccgcgccgtccacgaccacgcccgcgagctgtgggaccgcccgcacatcctcaccggtgacctctcgggggacatggtcgaacgcgccctcgcccagggcctggccgccatccgacaggccgcggaccatctcttcctggccgacggcaccatggacgcggcactgctcgcctacggcacccaccacatcgcgccgcaggagaggctcgccgccgtcaccgaggccctgcgcgtcgtcaaggacggcggccacgtggtcctgcacgacttcgacgacgccagccccatggcacgcttcttcaccgacatcgtccacccccacaccacagccggccacgactaccgccacttctcccgcgaccttctggccgaactcttcgccgaggcgggcacaccggcccgcgtcgtcgacctgtacgacccactcgtagtccgcggcaccaccgaggaggaggcgcgccgccgcatgtgcgcgtacgtggccgacatgtacggagtcggcgcgttcttcgccaccctgggcggaaccgacgcgtgctggcgactcctggaggagtacttccagcacgacacctacctgtcgaccctgcccgagcagaccgacttcaccaccgcgccgatcgtctaccgctccgagggcgccttcatcgccgagataccccgcgcggccatcgtcgccgtctcccacaagccacccacctga

SEQ ID NO: 34 - DNA, 61944 bp, Streptomyces refuineus
atggccgacccgctgctgttcaacccccgcacctacgaccccgggcacttcgaccccgagacccgcaggctgctgcgcgccaccgtcgactggttcgagcagcgcggcaagcgccgcctgatcgaggactaccgcacccgcgcctggccggcggacttcctcgccttcgccgcggaggaggagctgttcgccaccttcctcacccccgcccgcgagagcgacggccggcgggacaggcgctgggacaccgcgcggatcgccgccctcagcgagatcctcggcttctacgggctcgactactggtacgtctggcaggtcaccgtcctcggactcggaccggtctggcagagcggcaacgccgcggcccgcgcccgcgccgccgaactgctctcccggggcgaggtgttcgcgttcggcctgtcggagaaggcccacggcgccgacatctactccaccgacatgctgctggagcccgacggcgacggcggcttccgggccggcggctccaagtactacatcggcaacgggaacgccgcggggctcgtctccgtcttcggccgccgcaccgacgtcgaggggcccgacggctacgtcttcttcgccgcggacagccgccacccggcgtaccacgtcgtgaggaacgtcgtcgactcctccaagtacgtcagcgagttccggctcgaggactacccggtcggcccggaggacgtcctgcacaccgggcgcgccgccttcgacgccgcgctcaacaccgtcaacatcggcaagttcaacctctgcaccgcctcgatcggcatctgcgagcacgcgatgtacgaggcggtgacccacgcccgcaaccggatcctctacggccgccccgtcaccgccttcccgcacgtgcgccgcgagctgaccgacgcctacgtccgcctggtcgggatgaagctgttcagcgaccgagccgtcgactacttccgctccgcgggccccgacgaccgccgctacctgctcttcaacccgatgacgaagatgaaggtgaccacggagggcgagaaggtcgtcgacctgctgtgggacgtcatcgccgccaagggcttcgagaaggacacctacttcgcccaggcggccgtcgagatccggagcctgccgaagctggagggcacggtccacgtcaacctcgcgctgatcctcaagttcatgcgcaaccacctgctggacccggtcgagtacgcgcccgtgcccacccgtctggacccggccgacgacgccttcctcttccggcagggccccgcccgcggcctgggatcggtccgcttccacgactggcggcccgccttcgacgcccacgcccacctgcccaacgtcggccgcttccgggaacaggcggacgccctgtgcgagttcgtcgccaccgcggcccccgacgaggagcagagccgcgacctcgatctgctcctcgccgtcggccggttgttcgcgctggtcgtgcacggccagctgatcctggagcaggcggggccggccggtgtggacggggacgtgctcgacgaactgttcgccgtcctcgtgcgcgacttctccgcgcacgccgtggaactgcacggcaaggactccgcgacggcgccgcagcagcgctgggccctggacgcggtccggcgccccgtcgtcgacgacgcccggtcggcgcgcgtgtgggagcgcgtcgaggccctgtccggggcgtacgagatgacaccgtgaaccacgtggcgccgcaaggggaggcgttcgcgcctccggcggccgggcccgttccgggcggaccggaacgggcccggcccgcggcgcgccgccggtcctccggcgcccgccggcgggcgcgagaatatccggcgagtgattttccgtctctggttttacgttgaaccgaagatttcacgccggtgaagtaattcggaaccgcccgcgcggcggaatgtggcggccgcggcgccggcgtcggtcgcgtgatggcgccgaacgggaaaaggccgtcttcgccgcccgtcggcggggcgtgctccctccggacctcgaaagtttcggtacccggccgaaaccggcatccggcccgcctgcgagagaagtgcggacctcctgtcaagagcgtctcgtcggacaccctcttgcggtgaggccgaagatctgcatgtggcccccgggtgcgccggcccccggagcggccgccggagcgggaaacggacaaaaggcgggttatggtaatttacggtgcacccgctggtgaattgcgagtatttggcgtgaagttttgcggggtggattggatcttcaatttatttcgctgtgacccctgatcaaaacgagctcaggcctgtatggtgactgtcgagcggcccgatttttcgcacggatgcaccgggccggatattcccgcatcagggtcagaacgtacgcacaacctgtggaagccgctttacgggggaggccggcagagggtgtacgaccaggaagatccacggcgcagagccgtccggccggtgtgccggaaaccgtcggtggagtcgtcgcagacccggggggtccgcgacggcgcccccgcggcgccgaaggcccgggggaacgaggaggcgcggtgcgagccggccgcgggtgcgaggccgcggcccggcggagagcgtgcccgccgaggccgtgaggggggagggtggctcacgtgagcggacccccagcagacccgccggccggctcccacctggtggccgcgatccgcgcgacggccgaggccgaccccgagcgcaaggccgtcggcttcgtccgggatccggaacgcgaaggtgaggaggcgctgcggagctactcctggctcgacgacagggcccgccgcatcgccgtcctcctccgcggggcgcggctcggcgcgggctcgcgcgtcctgctgctcttcccgcagtccgcggagttcgcggcggcctacgccggatgcctctacggggggatggtcgccgtccccgcgcccctgcccacgggaacctccctggagaccgcacgcgtcgccggcatcgcccgggacgccggggcgggcgccgtcctcaccgtctccgacaccgaggcggaggtccggcggtgggcggccgagaccggtctgggcgacctgcccctgttctccgtcgacgaactgcccgacgacaccgacccgggggagtggcgggagccggagatccgggccggcaccgtggcggtgctgcagtacacctccggctccaccggcagccccaagggggtcgtcgtcacccacggcgcgctcgccgacaacgtccgcagcctcctgtccgggttcgacctgggaaccggcgcccggctgggcggctggctgccgatgtaccacgacatggggctgttcgggctgctgagcccggcgctgttcagcggcggcgccgccgtgctgatgagcggcagcgccttcctgcgcaggccgcacctgtggccgacgctgatcgaccgcttcggcgtggtcttctccgcggcgcccgacttcgcctacgactactgcgtacggcgggtggagcccgagcaggtggaccggctcgacctctcgcgctggcgctgggcggccaacggctcggagcccatccgggccgagacgctccgcgccttcaccaaggagttcgcccccgcggggctgccccacgacgcgatgaccccctgctacggactggccgaggcgaccctgctggtctccctgtcggcgggcgagctgcgcacccggcgggtggacgccgcggcactggagaaccaccgcttcgtcgaggcggccgcgggccgcccgtcccgcgaggtcgtctcgtgcggccggcccccggccctggaggtccgcgtggccgaccccgcgaccggagagcccgtcacgggcgatgcggtgggcgagatccaggtgcggggcgcgagcgtggccggcggctactggcggaaaccggaggcgaccgccgagacgttcgtcacggccgcggacggctccgggccctggctgcgcaccggcgacctcggcgccctgtacgagggcgagctgtacgtcaccggccgcatcaaggaactcctcatcgtgcacggccgcaacatctacccgcacgacgtcgagcgcgaactgcgcgcccaccacgacgagctcggcgcgatcggcgccgtcttctccgtccccacggaggagggcgaggccgtcgtggtcacgcacgaggtggtcccgtccgtccgggacgaccggggccccgcgctggtgacggcggtacgggcgacgctcgcccgggagttcggcctggcaccggccggggtggtgctggtgcgccgcggccgcaccccgcgcaccagcagcggcaaggtgcagcgccgcctggccgcccggctcttccgcaccggggaactcgcccaggtccacgccgaccccggtgcccaccggctcgtggcggcgctccgcgaggcggacggcctgcgcgacgcccccgcgtccacgacatgacctccccatcgtcctgatccgctcccagcgtcgggcggctccccgaatcccgggctccgagcgtctcggagcaccggccggcccctcagcgggagccgtccggccgggatgccctcccgacggccgaccggttgcccgcacaccgaagacagaggtcctacccgcatgtccctgtccccgccttcttcgtccccgccttcttccccgcccccttctccgccgcacgaccccgacgccctgcggcagtggctgcgcgagcagtgcgccgactgcctcggcgtccccccggcatccctcgccaccgacgtccccctcaccgactacggcatgacctccgtcaccgggaccgccctgtgcggcatggtggaggaccacctggacgtcgagtgcgacctgagcctgctctggcaggagcagacgatcgacggcatcacctcccggctggcctcgcgcaccgcgcgctgacggccgtccggccctgtccccacaccacgcacacgtacacgcacatgccgaggcactcgtgcgtgcggacgccgctgcgcgatcgggcgtgccgacaacctttcagtcctagggcgggagaagcatgttggagtccccggcagaccgcgtggccgccacctcggcccagtccgggatctggacggcacagcggctgcgctcggatgaccggctctacacctgcggcctctacctcgaactcgaccacgtggtggaggaggtgctgggcgaggcgatcggccgtgcggtcgccgacaccgaggcgctgcgcaccgccttcggggaggacggggacggcgcgctggaacagcgcgtgctcgcgcggccgccggacacgcagacacggctgttccggctggacctgggcggagacgaccggccccgcgccgaggccctggactggatggaccggcagcaggcggaaccgtgggacctcgccgccggcgacacctgccggcacaccctgatccgcctcggcggccaccgcaccgtcctgcacctgcgctaccaccacctcgccctggacgggttcggtgccgcgctctacctggacaggatcgcggcggtgtaccgggcgctgcgcaccggccgggagacgcccccctgcaccttcgcgccgctggcccgcctcgtggaggaggaccgcgcctaccggcggtccgcccgccaccgcagggacgccgaccactggcggacgcgcttcgcggacctcccccgccccaccagcctcgccggcgccgccgcgcccgccgcgcccgccgcgctgcgccacacggtccgcgtgtccgcggccgacaccgccgcactgggcctgcgggcggaccggagcggcagcacctggccggtgttcgccacggccgcggtggccgccttcctgagccgcctcgcgccgggggaggaggtcgtcgtcggcttcccggtcaccgccagggtcacgcccgccgcggtgcgcacgccggggatgctggcgaacgtcgtgccgctccggatccgggtgcggcaggggatgtcgttcgccgcgctgctggaccggaccgcggccgagatcggcgccacgctgcggcaccagcgccaccgcaccgaggacatcggccgggcgctcggcctccccccgcacggcgcccagccggccccgaccctggtcaacgtcatggccttcgccccggtgctcgacttcggcgactgcctctcgccggtgcaccagctgtcggccggcccggtcgaggacctggcggtcaacctgctcggcacccccggggacggccgggagctggagatcaccgtcgccgccaaccccctgctccactcggaggacgcggtggcgtcgctggccgcgcggctggcggagttcctggcgcgcgcgggcgagcacgccgacgccccgatcggccggacacgcctgctcggcgcggcggaggaggccgaggcgctggccgccgggcggagcccgcgacgggacctccccgcccgcaccctgcccgagctcttcgcccggcaggccgcccgcacccccgacgccccggcggtcgcctcggaccgcacgacctggacgtacgcccggctcgacgcgcacgccggcagggtggcccggcggctggccgcccggggcgtggggccggagagcatcgtcgccctcgcggtgccgcgcggggtggagctggcggcgctggtcatcggagtgcagcgggccgggggcgcctacctccccatcgacccggagtacccggccgagcgcatcgggttcctgctgcgcgacgcccgccccgccctggtggtctgcgagcccgggacggaccttccggacaccgggtgcccgcaggtgccggccggcgacctcctcgacgccggggtgcggtgcgcggaggcggaggaaccggcgcccggggacctcccggcggacctgcccgcctacgtcgtctacacctccggctcgaccgggcggcccaagggggtcgtggtcacccacgccggcatcgccgccctggcggcggagcagatcgaccgctaccggctgggccccggctccagggtggcgcagctcgcggccctcgggttcgacgtcgcggtcgccgaactcgcgatggcgctgacctcgggaagctgcctcgtcctcccgccgcacggactcgccggcgaggaactggccgagttcctgcgcagccggcgcatcacgacggccctcaccacggcctccgtgctggccacggtgccccccggcgacttccccgacctgtccgacctggccaccggcggcgagcagcccccgcccccgctgatcgcccgctgggcgcccggccggcggatgttcaacgtctacgggccgaccgaggcgaccgtccaggccacctccggacgctgcgcggcgggcggggagcggatgccggacatcgggaacaccgaggcgggcgtggacgcctacgtcctggacggggcgctcagacccgtgcccgacggggcgaccggagagctctacctgcgcggcagggggctggcccgcggctacctgcgccgccccggcctcaccgccgcacgcttcgtcgccgacccccacaccgggacgggcgagcggatgtaccggaccggggacctggtgcgccgggtgcccggggagggccgcaccgtgctggagttcgtcggccgggcggacgaccaggtgaagatccggggtttccgggtggagccgggcgaggtggaggcggccctcgccgaactcgacggggtggcgcaggcgctggtgaccgtgcgcgaggaacggccgggcgaccgcaggctcgtcggctacctggtgcccgaccccgcgggccgggacggctccgcgcggggcccggacgtcgagcggtggcggaggctgatcgccgcccggctgcccgcccacctggtcccctcggcgctggtggagctggcggagatcccgcgcaccgccaacggcaaggtggaccgctcggcgctgccggcccccggcggcacgcccccgcccgcgggacgggcaccgcggaacgcccgcgaggaggccctgtgcgcgctcttcgccgaggtgctgggcgtcgaggaggtcggcgccgaccacgacttcttcgccctgggcggcgactccctgctggccgcccggctggcgagccgcatccggaaccggctggggaaggcggtcacggtacgggaggtcttccgggccccgaccgccgcaggcctcgcggaggcgctcggcggcgaggcgcgggcggacggccgcgtccgtccggtccggcctcgcccggagcgggtgccgctgtcggccgcgcagcgccggctgtggttcatcgacgaactccagggggcctcggccgcctacaacatcccgaccaccctgcgcttcgacggaccgctggacgtccccgcgctgcacgccgcgctgggcgacgtggtggaccggcacgaggccctgcggaccaccgtccggcccgcggcggaggacgccaccggggcggccgccgcacccgagcagcacatcgcccccccgggcggccaccgcctcccgctgccggtgcgcgacatcgcccccgaggagctcgccggggagctgcgcgcggccgcgggccacgtcttcgacctcacccgggacctgccggtacgcgcccggctctaccgcaccgccgagcgggagcacgtcctgctgctgctcgtccaccacatcgccgccgacggcgcgtcgatggggcccctgatcggggacctggctacggcctacacggcccggctcgcgggccgggcccccgacctccccgcgccggaggtgacgtacgccgacttcgcgctgtgggagcaccggggcggggagcacgccgcggcgcaggccgaggggctcgactactggcgccgggccctggccgggctgccggaccggatccggctccccgccgaccggccccggtcgcaggagccggtccgccggggcggagcggcacggttcgaggtgccgcccgcgctgtacgccaggctggcggagctggccggaagcgtgcgcgccaccccgttcatggtgctgcagaccgcggtcgccgtcctgctgagccgcatgggcgccggcccggacgtccccctgggcacgcccgtggccggccgcccggacgaggcgctcgacgaggtcgtcggctgcttcgtcaacaccgtggtcctgcgcaccgacgtctcgggcgacccgaccgtggccgagctgctggcgcggacgcgggacggcgacctcgcggccctcgcccaccaggacgtgccgttcgaccgggtcgtggacgcggtcaaccccgtgcgctccatcgcgcggcaccccctcttccaggtcatgctcgtcctcaacggcgcggagcagcgccgggggcgggcccgcttccccggcctggacagccggatcggggcggtggactccggcgagacgaagttcgacctctcctggcacttcacgcaccgggacgggcccgagcgggcgctggagggaacgctcgtctacgccgccgacatgttcggcgccgccaccgcccgccggctcaccgagcggctgctcggcgtgctgaccgcgatggccgacgaccccggccggccggtcgggtccatcgacgtcctcagcgccgccgagcaccgcgcggtgcgggcgtggggcaccggcgcggcccaggaccgcacccgccgccccgagccggtggccgggaggatcgccgcccaggcggcccgcacccccggcgcgcccgcggtgaccgaacccggccgggtgtggacgtacgccgaactcgacgcccgcgccaaccggctggcgcgcgccctggccgcccggggcgtgggcgccgaggacctcgtcgccgtgctcctgccccgcggggcggacctggtcgccaccctgctgggagtgctgcgggccggcgcctcctacctcccgctcgacaccgggcacccgtcggaccgcaaccggtgggccgtctcggacgccgccccggcgctggtggtgaccgacggcgcgcaccgcggcacgctccccggggagaccgggtgcgccgtgctggtcctgggcggggaggacgccgaggccgaactggcgggccgcgcccccaccccgccggacgagaccgacctcgcccggccggtggccggggccaacgccgcctacaccatccacacctcgggttcgacgggccgccccaaggccgtcgtcgtcacacgcgacgcgctggatgcgttcgtcgagcgcaccgtcgacacctacggggacgcgctgcggggcacctccctgctccactccccggtcgccttcgacctcacggtcgccaccctctacggaccgccggccgccggcgggcggatccacgtggaggacctcgacgaggccgggatcgcgcggtgggagcgggagtgcccggccttcctcaaggccacgccctcccacctggcgctgctggaggagttcggcggctccgcggcccccggaacggtcgtcctggcgggcgagcagctcctgggcgcgcggctggaccgctggcgggcccgccaccccggcaccgccgtcttcaacagctacgggccgaccgagaccaccgtcaactgcctggagtacaggatcgccccgggcgcggagacggccccggggcccgtgccggtgggccgcccggtggcgggcgtccgggtgcacctgctcgacgcccgcctccgcccggtcgccccgggtgtgacgggcgaactgtacgtctgcgggcccggggtcgcccgcgggtaccgcgggcggccggcggccaccgcggagcggttcgtcgcctgcccgttcggggagccgggggagcggatgtaccgcaccggggacctgatgcggtggaccccggacggcgcactgctctacgagggccgggccgacgcccagctgaaggtgcgcggcttccgggtggagcccggcgaggtggaggccgcgctgctggacctccccggcgtgcgggaggcggccgtgaccctcgtcggcgggcccggccgggggtccggccaggcgggcggctccgccgcccccgcccgcctggtcggctacgtcgtcggcggggcctttgacccggccgccctcctggagcggctgcgcgtccggctgcccgaccacatggtgcccgccgcgctcgtggagctggacgccctgccgctcacccccaacggcaagctcgaccgccgggccctgccggcgcccgacttcggccgccacgcgggccgccgcgctccgcgcggaccgcgggaggagctgctgtgcacgctcttcgccgaggtgctggggctgcccgaggccggcgccgaggacagcttcttcgcgctcggcggcgacagcatcgtcagcatccagctcgtcggacgcgcccgccgggccggactgcacttcaccgtgcgcgacgtcttcgagcaccccacggccgccgggctggccgccgtggcccgggccgccgacccggccggggacccgggcacccggcccgcgccgggacttcccccgagcgggccgctgccgtacgtcccggccgccgcgcggctcgtcgccaggaccgggtcgatccgcgcccggggcgccgaccggttccaccagtcggtggtcctcaccgcccccgcggacgccggcccggacgacgtccggcgcgtgctgcagacggtgatcgaccaccacggggcgctgcgcctgcgggccgccgcggaccgcgacggagcgccggacggcctggtgatcggcgaaccggggtcggtcgcggccgcggacctgctgcgctgccgcgacgccgcggggctgccggaggcggcgctgcgggaagcggtggagcaggaggcccggcaggcccgggacggcctcgacccgagcacgggatccgtgctgcgcgcggcctggctggaccgcggcccggaccggggcggcctgctggtgctggtggcccaccacctgagcgtggacggcgtctcctggcggatcctgctggacgacatccgccacgcctggagcacgcccgccggccccgccggggggacccccctgccgccggagggcacctccctgcgggagtgggccacccggaccgccggagccgccgccggggccgccgtgaccggccggctcccccactggcggcagaccctggcgggcctggaggacccggacggcgaggtggtcgccctggaggtgcggctcgaccccgccgccgacacccacggctcggcgcgcgagaccgcgcacaggctgccgcccgacctgaccgacgcgctcgtccgcaccgcgccggcggcgctccgcgcggagcccggtgagctgctgctggccgggtacgcgctggccgcctcccgggccctgggcggccggcccgtgttcgtggtggagaccgagggccacggccggcaggacgcgctcctgccggggatcgacctgtcccgcaccgtcggctggttcacctccgtccatccggtgcggctcaggcccggcgccggggccgcgcggctgctgaaggagaccagggagcggctgcgcaccgtgccggacgccgggctgggccacgacctgctccgccacggcggcgcggcgccgtcctccggggagggcggccgcgggctgccccgcccgcagttcggcttcaactacctcgggcgggtggccgtggccgaggcccccgccggcacggacccgggcgggacgtgggcgttcgcgggccacagcgtcgccccgcagccgcccgagctgccgctggcgcacgaggtggagctgaccgtcgtcctggaggacggccccggaggaccggtcctggcggcgcgctggaacgcctccgcccgctgcctgtcccgggcgcggcaggacgcgctggcgcgggagtgggagaaggccctgcgcgaactcgtcgccctggccggcaccgccgggggcggcggcctgatcccctcggagaccggcgccggcggcctggaccaggacgagatcgaggagtgcgaggcggcggcggacttcgaggtcgccgacctgctcgcactcgcgcccgcccaggaggggctgctcttccacagcaccttcgacgacgaggcggaggacgtctacgtcggccagctggcgctggagctccacggggagctgtcgggcgcccgcctgcgggaagccgcccaaggcgtcctcgaccggcacgacgcgctgcgcgcggccttcctccagcgccgctccggcgagtggatccaggcgatcgccgcacgggcgccggtcggctgggaggagcacgacctgtccggaccgggcggacaggagcggcagcggaggctggaggagctgctggccggacagcgcacccgccggttcgacctctccaggccgccgctggtgcgcttcctgctcgtgcggaccgcggcggaccggcacgtcctcgccctgaccaaccaccacctggtgctcgacggctggtcgctgccgctggtggtgcgcgacctcatggcgctgtacggggcggacggcggcgcggccctgcccgccgcgcggccgtaccgcgactacctcgcctggctcggcgggcaggaccgcgacgcggcccgggaggcgtggacacgggcgctcgccgggctccagccctcgctgatcgccccgaacgcccgccgcgacggcgcggcgccgctcccgcactaccgcaccatggacccgcaggtcgtctcccgcctcaccgcttgggcccggcggcacggcgtcaccctcaactcggcggtcgaggcggcgtgggcgctcctcctgggccggctcaccggccgggacgacgtgagcttcggcatcgcggcctccggccggcccaccgacctgcccggcgccgcggagatcgtcggcctgctgatgaacaccgtgccggtgcgcgtcgtcctggaccccggcgagccgctggaggccctcgtccggcgcgtgcagcgggagcaggccggcctgctggaccaccagttcgtccccctggcgcaggtgcagcgctgggtgggaggaggcgacctcttcgacaccacgctcgtcttcgagaactacccgctggaccccgccgccggcctcaccgccggcgaggccggcggcgacgggccccggctgcacgacgcgcgcggccacgacagcaaccactacccgctcagcgtcaccgtcggccccgcccccgacctccagctccgcttcacctaccgccccgacctgttcgcaccggagtgggtggaggagctggcggcgcggttcgagcaggtgctcgacaccatggcggcgtccggcaccaccccggcgggccggctgggcgtcctgctcccgcacgaacgcgccacgctgctgggcgactgggcgcgcggcgaggcggcgagcggacgggagtgccccgtcgccctcttcgaggagcaggccgcccgcaccccggacgccctcgcgctggtcgagggcggcgacggcggactccgtctgacctacgccgagttcgacgcgcgcgccaaccgcatggcgcgcttcctcaccgcccgcgggatcggggccgaggacctggtcggcctggtcttcccgcgcggcgccgacctgctcaccggcctgtggggggcgctcaaggccggtgcggcgtacctgccggtggacgtggactacccggccgagcggatcgggctgctcctctccgacggcgcccccgccctcgtcctgaccacctccgcccacgcccacctggtgcccgaggcgccggggcggcagatcctctgcgtcgacctgcccgggcccgcggacgaactggcccgcgccccggagggaccggtgaccgaccgggagcgtccgcgcccggtcggggccgacaccctcgcctacgtcctctacacctcgggctccaccggccgccccaagggcgtggccatcagccgcggttcgctggccgcgcacgccgtccggtcccgcgaccgctacccggacgccgccggggtgtcgctgctgcactccccggtggcgttcgacctcacggtgacggccctgttcaccacgctcgtctccggcgggaccctgctgctggcggagctcgacgaacacgcccagggcgccggcgtcaccttcgtgaagggcacgccctcccacgtcgcgctcctggacgagctgcccggcgtcctcgacgccaccggggaacgccccggcacgctcgtgctcggcggcgagccgctcaccggcgagatgctggagcgctggcgcgcacgccacccgcaggccagggtcttcaacgactacgggccctcggagaccagcgtgaactgctccgacctggtcttcgagcccggtgacgaggtgccggccggcctgctgccgatcggccggccgctgcccggcaaccacatgttcgtgctcgaccacctgctccagcccgtgccggtcggcgtcgtcggcgagatctacgtctccggtgtcggcgtggcccgcggctaccacggcaggccgggcctgaccgccgagcgcttcctgccctgcccgttcgacgccccgggcgcccggatgtaccgcaccggggacctgggccgctggcggcccgacgggatcatggagtgcctgggccgcaccgacgaccaggtcaaggtgcgcggcttccgggtggagctgggagaggtggaggccgccctcgccgcccgccccgacgtcgcccgcgccaccgtcgtcgtgcgcgaggacgagccgggggacaggaggctgacgggctacgtggtgcccgagggagggccggaggcgggcctcgacaccgccgccgtgctgcgcgacctcgccgcacagctgccggagtacatggtcccggccgcggtcgtggtcctggcggagctgccgcgcaccgagaacggcaagctcgaccgccgggcgctgcccacacccgagtacggcaccaggtccgccgggcgggcgccgcgcaccgccgccgagaccgccctgtgcgccctgttcgcggaggtcctgggagtgcccggggccaccgtggacgacgacttcttcgccctgggcggccactcgctgctggccgtccggctcgcgggccgcatccgggccgagctcggcctgcggctggacatccgcacgatcttcgaccgccgcaccgtcgcggacctcctggccgatccgcagatcgccgcacagctgacggacggcgaggtccccggggcgccggcgcggccggcggagcccgcgccgggcgggcagcccccggccggggagcgaggcggcgccggggccgggcccgagcgcctgcccctgtctcccgcccagcgcagactgtggttcctcaaccgctacgacagggaggccggcggctaccacatcagcgtcgcgctgcgcctgaccggcgacctcgacgtcggcgccctgcacgcggcgctgggcgacctggccgcccggcacgagagcctgcgcacggtcttccgcgaggacgaggaggggccctaccaggtcgtcctgcccgcggcgccgtccccggcgccggccgccgtccccgcctccgcgcgggagctcgacgcgctggtgcgcgaagccgtccgccggcccttcgacctcgccgaggacaccccgctgcggcacaccctgttcgcgctcccggaccgcgagcacgtcctgctcctggtgatccaccacatcgccgccgacggctggtcgatggggccgctggcccgggacctggccgccgcctaccgcgcccgcgcggccggcgacgcgccccggtggccggcgccggcgccgagccacgccgatcacgtgctccggcggcaccgcgcgccggagcacggtggggacgccggcgacccggcggaccaccggctcgcccactgggccgaggagctgcgcggactgcccgacgagctcccgctcccctacgaccggccgcgccccacgacaccccccgggtacgccgagcggatcggcttccggatcgacgccggactgtaccgggacgtgctggccctggcggcccgccaccgggccaccccgttcatggtgctccacgccgccctggccgccctgctgacccggctcggcgccggcaccgacatccccgtgggcaccccctcggcgggccgcgaccggcccgagaccgccgacctcgtcggcttcctggtcaacaccctggtcctgcgcacggacacctcgggcgacccgacgttcggggaactgctggaccgggtgcgcgagaccgacctgagggcgtacacccaccaggacgtgcccttcgaacggctggtggaggcggtcaaccccgcccgctcgcccagcaggcacccgctcgtgcagaccatgctcaccctcgacaacgcggcccagggagcgctggagcacctcctggacctgccgggggtgcgagcggagctgctgccgaccgccgagggcaccgcccacaccgacctcgacctgaccttcgccgagaccggctccgccccgcccgcgggcgggacgggactcgacgggaccctgcagtaccgccccgacctgttcgaccgcgcgaccgcgcaggccctggtggagcggttcgtggcgctgctgcgcacggtgacgcgcgagcccggcctgcggctgggccggctcgacgtcaccaccggcgaggagcgccggcggctggtcgaggaggacgccgccgcccggcgggcgcgggccgagaccaccgtcacggacctgcccgcgctgttcgccgcctgggccgagcggaccccttccgcccccgccctcaccgacggcgggacgaccgtggactacgccgaactggacgcccgctccaaccgcctggcccgcgcactgctggaactcggcgtggggccggaggacttcgtcgccctggccgtgccccgctcggcggacctggtggtggccgtgctcgccgtgctgaagtcgggcgccgcctacctcgcggtggaccccgactacccggccgagcgcacctcctacatcctcggcgactgccggccggccgcggtgctctccacgaccgcggtccgggcggccctgcacggcacggtgggcgaggcggccggcgaggtgccgtggctgctgctcgactcgccccggacccgcgccgcggcggccgggctgtcggcggcgccggtcaccgacgccgaccgccggtcgcccctgctccccgaccaccccgcctacaccatctacacctcgggatcgaccgggcggcccaagggcgtggtcgtcagccacgccaacgtctcgcggctgctggacgtctgccgctcggccgtggacttcgggcgggacgacgtgtggacgctcttccactccagcgccttcgacttctcggtgtgggagatgtggggagccctggcgcacggcggccgactggtggtcgttccgcacgacgtggccagatcccccagggacctcctggagctgctgggccgcgagcgcgtcacggtgctcagccagacgccctcggccttcctccagctcctgcgggccgagaccgagcggggcgtccccgcggaggccaccgccgcgctgaggtacgtcgtcttcggcggcgaggcgctggacaccgcccagctcgccccctggcggggccgcccggtccgcctggtcaacatgtacgggatcaccgagaccaccgtgcacgtcacccacctggagctggacgacgccgccgtggagcgcggcggcagcctcatcggctcccccctggacgacctgcgcgcccacgtgctcgacgaacggctgcgccccgtgccgtcgggcgtcgtcggcgagctgtacgtcgccggccccggcctggcccgcgggtaccggcagcgccccggcctgacggccgcccgcttcgtcgccgacccgtccgacgccggcgggcggatgtaccggaccggcgatctggtcaggcgcgccccggacggcggcctccactacgtcggccggtccgacgcccaggtcaaactgcgcggctaccgcatcgagccgggggaggtcgaggccgccgcacggcgccacccggacatcggccaggcggccgcggtcgtgcacggggacggaccggacgaccggtacctggtctgctacgcggtgccggacggagacgccgaccccgacccgcacgaggtgcgcgcccacctggccggcgccctgcccggctacatggtccccgccgccgtggtgctgctgcccgccctgccgctgacccccaacggcaagctggaccgcagggcgctgcccgccccggaccgggcggcactggccaccggcggcgctccggccggaccgcgcgaggaggcgctctgcgcggccttcgccgacgtcctccgcgtcgaggaggtcagccgggacgccgacttcttcgccctgggcggccactccctgtcggccgtgcggctcatcagccggatccggtcggcgctgggggtggagatcggcatccgcacgctcttcgaggcgcccacgcccgccgcgctggcccggcggctggacaccgccggagccggacggccccgcctggtgccgcagcggcggccgcaccgcgtcccgctctcctccgcccagcggcggctgtggttcctcggggagctggaggggcccggcgcgacgtacaacattccgctcgccctgcggctgcgcggtcccctggacgtcggcgccctgcgcgccgcgctggcggacgtggtggcccggcacgaggcgctgcgcacggtcttcccggccgagaacggagtcccccaccagcacgtggtcgcgcccgaggaggccgcgcccggaccggccgtcgtggacgtcgccgaggaggagctgcccgcggccctcgccgaggcctgcgcatacgcgttcacgctgaccgaggacctcccgctgcgggcggtgctgctgcgcaccggccccaccgaccacgtgctctccctggtcctgcaccacatcgccggcgacggctggtcgctcgccccgctcgcccgcgacctgagcaccgcctacgccgcacgcctggagggccgcgccccgcggtggcggccgctgccggtgcagtacgccgacttcaccctgtggaaggagcggctgctcggcgaggcggacgaccccgacagcctcttcgcacgccagctcgccttctggcgtgacaccctggcgggggcgccggagcagatcgagctgcccaccgaccggccgcgccccgcgatggagagccaccgcggcgcgatccaccgcttcaccctgccggcacggctgcgggaccggctgcgtgcgttggcgcactcccggcaggcgaccttgttcatggccctgcaggcgggcctggcggcgctgttcgccaagttgggggccggccgggacatcgtcctgggcaccccggtcgccggccgcggcgacgaggcggtcgacgacctcgtcggcttcttcgtcaacaccctggcgctccgcaccgacctcggcggcgaccccacgttcgaggagctgctggaccgggtgagggaggcggacctgtccgccttcgcccaccaggacataccgttcgagcagctggtggaggcgctcaaccccacccgctccctctcccggcaccccgtcttccaggtgctgctggccctccagaacaacgaactcggcgaggccgtcatgccgggtctggaggtcaccgtggaacgccccgcccaggtggcggccaagtacgacctcttcgtgaacctggtggagtcccgggacccggccggcggcgcgaccgccatcgagggcgccgtcgagtacgccaccgacctcttcgacgccggaaccgtcgcacggctggccgagcgctaccaggacctgctcctggcggtcaccgaggagcccgcgacgcggctcagccggatcccggtgctgagcggggccgaacgcggcatgctggcggccgagtgggacggcaccgccgcgggcccggccgaggacgtggccgacctcttccgcgcccgcgccaccgcgacgccggaggcggtggcggtccgctgcgccggggagagcctcacgtacgccgagctcggcgagcgggccgaccgggtggcggcggcgctggccgggcggggcgccggccccgaacggcgggtcgcggtgtgcctgccgcgcaccgccgacctggtggcctgcctgctcggagtcctgcgggccggcgccgcctacgtgccgctggacccggagtacccggacgagcgcatcgccgcgatcctgtccgacacccgcccggtggcgctgctcaccacggcggactgccgccccgcgatcaccgctgccgcggccgcctgcggtgccgccaccctcctggcggccgacgccgcacagggcgccgggcccctgcccgaggtgcccgcgccgctgccggaccaggccgcgtacgtgctgcacacctcgggctccacgggacggcccaagggcgtggtcgtcagccggggcaacctcgccaacctgctggccgacatgcgggagcggctgcgcctcaccgccggggaccggctggtggccgtcaccacggtcagcttcgacatcgccgccctggagctgttcctgcccctggtcggcggcgccgaactggtcctggccgaccgcggcaccgcacgggacccggaggcactggcggcactgctcaccgggagcggcgccaccatcctccaggccaccccgaccacctggcagctgctggccgagaccgcgcccgacgccctgcgcgggctgcgcaaactggtgggcggcgaagcgctccccgcgtccctggcctcccgcctgcacggcctgggcggcgaactggtcaacgtctacgggcccaccgagaccaccatctggtccaccgccgcccacctcgaccgggccaccgggagcgcaccgcccatcggccgggcgctgcgcaacacccgcgcctacgtgctggacgagtggctcgacccggtccccgccggcgtccccggcgagctctacctggccggcgccggcgtggcccgcggctacctgggccgcggcgccctgaccgccgagcgcttcaccgccgaccccttcggcgcgcccggcagccgcatgtaccgcacgggcgacctggtccgccggcgcgcggacggggagctggagttcctcggacgcaccgaccaccaggtcaaggtccggggcttccgcatcgagctgggcgagatcgagacggccctcggtgcgcacccggacgtctccggggcggtcgtggtcgcccgcggcgcgtccggcccggcccccgcgccggacgacggcggcaccgccggcccgccccggcagctggtggcctacgtggtcgccgagcccgaccgggccggccacgacgggagccgggagcgggcccggctcgacgagtggcgggagacctacgacaccctctacgacaactccgaaccgacccccctgggccgggacttcgggatctggcggagcagctacgacggacggcccatcccgctggaggagatgctccagtggcgggcggccacggtggaccgcatccgggcgctgcggcccgcgcggctgctggagatcggggtgggcaccggactgctgctgtcggaactggcaccggactgcaccgcctaccacggaaccgacctgtccgcacgggtgatcgagaccctgcacgagcaggtcgcggccgagcccgcgctgaaggagaaggtggagctgcacgtccgcccggcgcacgacttcaccggtctgcgcaggggtttctacgacaccatcgtgctcaactccgtcgtccagtacttccccggcgccgactacctctcccgggtgctgcgcggcgcactcgacctgctggagcccggcggacggctcttcgtcggcgacgtgcgcagcctggcgctgctgcgggccttccgcgcctcggtggagatcggcgacgccgccgcgggcgacgccccgggcccggtgctggcggccgccgaccgcaggacggccacggagaaggaactcgtcgtggacccgggctacttcgcgcggctgcgccgggagaccggcgaacccctcgtcctggacgtgcgggtccggcgggggaggccgctcaacgagctgacgcgctaccgctacgacgtcctgctggccaagccggaggccgggaccgccgctccggccccggccgccgagatgcgctgggcggaggaggtcggagaccgcgcgcggctggccgaggtctgcgcggcacaccgcggcgcgctgcgcgtcaccgcgatccccaacgcccgggtgcggcgcgagacggccgccctcgccgcgctggaggacgggcggccgctcgccgcggcgcggcggctgctggacggccccgccggcggagtggacccggaggacctgtacgacgtggcggcggcggccggccgcaccgcgtgggtgtgctggtcggccgagggaccgccggacaccgtggacctggtgctggccccggcggacgggggcggcgccgcggaggtggcaccgccggccgagctgtggccgtacgagccggacgcggaccggccgcagaccaacgacccgtccgccgcgctgcgcaaccgggaactggccgccgggctgcgcgcgtacctggccggacggctgccggactacatggtgccctcggccgtcgtcgtcctcggcgccctcccgctgaccgccaacgggaaggtggaccgggccgcgctgcccgaccccgacccggcgggcgcggccggcggccggccaccgcgcacgccccgggaggagctgctgtgccggctcttcgccgacctgctgggcctgagccgggtgggcaccgaggacagcttcttcagcctgggcggcgacagcatcctgtccgtccgcctcgtcagccgcgcacgggaacaggggctgccgttgaccacccgcgacgtcttcgagcaccacaccgtggccgcgctggcggcggccctggacggcagggagccggagcagaccgcggccgacggccggccggaccccgccgccggaccgcggcccatcagcgccgaggaactcgccgagctggaggaagagctcggcgcggactgggaggagatgcagtgagcggctcgcagcgcatggtcgaagaggtccttccggtcaccccgctccaggaggggctgctcttccacgcggtcttcgacgaggacgtccccgacgcctacgtcagccggctggtcctcgccctccgcggcgacctggacgccggccggctgagacgggccgcccaggcgctggtgggacggcacccggcgttgcgctcggccttccggcagcggcgctcgggggagtggttccagctggtcgcgtcccgtcccgcggtgccctgggaggagctggacctgcggtccgccgggggcccggccgaggcggacaagcacctggaggcgctcctggacgagcaccaccggaccgggttcgacctcggccggccgcccctgctgcgcttcctgctcgccaggaccggggaggaccgccaccggctggcggtgacctaccaccacatcatcctcgacggctggtcgatgcccatcctgatgagggaactggtcgcgctgtacggcagcgggggcgacccctccgcgctccggccggtccgcccgcaccgcgaccacctcgactggctggcccgacgcccgtccgaacggagcgcccacgcctggcggcaggcgctggcgggactgtccggacccacgctggtggcgccgggcgcggaccgcaacggcccgctgccgcagcaggtgtggacgcggctgaccgaacgggacacccgggcgctcaccgcgtgggcgcgcgcccgcggcgtgacggtgaactcggcggtgcaggccgcctgggcgacggtgctcggccgcctcaccggccgcgacgacgtcgtcttcgggacgaccgtgtcggggcggccgccggagctgcccggtgccgaggacatggtcgggttcttcatcaacacggtgccgctgcgggtgcggatgcggccggacgagccgatcggcgacctcgtcgcccggatccagcgcgagcagaccgccctcatggagcaccagcacgtcagactgtccgacatccagcgctggtcgggacaggccgaactcttcgacacctccacggcgttcgagaactaccccgccgacgacctcgccgccgtcggctcctccgaccacgccggcctgcgcgtggaggggggctccggggtcaccacgaaccacttccccctctccctctacgcactgcccgggccggcgctccgcctgcggctggaccaccggcccgacgcggtggaccacgacaccgcacgacgcgcggcggacctgctgggacgggccctggccgccgtcctgggcgcccccgccaccccgaccgccgcggtcgccgccccgcggcaggcaccgcgaccgcgggagcggtgcgccggcgccgccccgcggggcccccggaccacgatcgtggcggcgttcgaggcgcaggtgcgcgcggcgcccggcgcccccgccgtcctggccggcggccgggagctcacctatgccgagctcgacgcccgcgcgaaccggctggcgcggctgctgatctcccgcggggtcggccccgagagccgggtcgccctcaccgtctcccggaacgcgtggctgcccgtcgccgtcctcggcgtcctcaaggcgggcggctgctacgtccccgtgagcgcctcgctgccgagggagcgcgccgccttcctcctccgcgggaccgcgccggtctgcctgctcaccgaccccgatgcggaggccgcccggcacgccgccgccggagcgcaggacccgccggggaccgcccggagcggcgtcgagcgcatcgtcctgaccgaggagctgctcgaccggtacgacccgagcgcgccgaccgacgccgagcggaccgcgccgctgctgccgggccacctcgcctacctcctgcacacctccggctccagcggccggcccaagggggtggcggtcgaacacgcccaggtggccgcactgctgtcctgggccgtcaccggcctcggcgccgaccggctgcgccgcaccgtggccgccacctcggagagcttcgacgtgtcggtcttcgacaccctcgtcccgctgctcgtgggcggccgcatcgagatcgtggagaacacgctggccgtcgccgaccgggccggcggcgagccctccctgctgaacgccgtcccctcggccctgcaggcgctgctggaccgcggggcgccgctcgccgtcgacaccttcctctgcgccggcgagcccttccccgcctcgctggccgcggccctgcgcgccgcctgcccgcgggcgcgcgtcggcaacctctacggcccgaccgagacgaccgtcttcgtgaccgcccggttcctggacggcaccgaggacggggcaccgcccatcggccggccgctgcccggcgtgcggatccacgtgctcgacccctggctccgcccggtgcccgagggggtggtgggcgagctctacatcgccggggaccacgtcacccgcgggtactggagaagcccggcgacgacggccgagcgctatgtcgccgaccccttcggcgcgccgggcgagcggatgtaccgcagcggcgacctcggacgccggctccccggcggggagatcgacatggtcggccgggccgacggccaggtgaaggtgcgcggccaccgggtcgagctgggggaggtggagtccgcgctcgtctcccacccggacgtccggcaggcggcggccaccgtgcacgacggcggtcccgccggaccgcgcctggtgggctacgtcgtgcccggcgacacggtgcccgacaccggcgcggtcctcgaccacctgcggctgaggctgcccgcgtacatggtgccctcggccctggtggtgctggacgagctgccgctgacggggaacggcaagcgggaccgcgccgcgctgccgcccccgccggaccggagcgccgcgacgcgggcgcgcgctccccgcggcccgcacgaaacgatcctgctcgccctgttcgccgaggtgctcggggtgcgcccggccggcatcgacgacgacttcttcgcgctgggcggccactcgctgctcgccacccgcctggtcagcagggtgcgcaccaccctcggcgccgaactgggggtgcgggacctcttcgagcaccccacggtggcggccctgggcgccaggatcgcccgggccgggacggcccggccgccggtctcgcacgtccgggagcggcccggccgcatcccgctgtcgttcgcccagcggcggctgtggttcctccaccgcctgcagggcggcagcgccgcctaccacgtcccgctcgcactccgcctcaccggccgcctcgacacggccgcgctgcgcggcgcgatcgccgacgtggtggccgggcacgggagcctgcgcacgtcgttccacgaggacgccgagggtccccaccaggtcgtgcgggacgccgcggaggccgccgaactgatcaccctggtcccggagccggtcgacgacccgctccgggcggcggacgaggcggtggccgaacccttcgacctgacggccggcctccccctgcggtgccggctgttcacccggaccggaacgccccgggcaccgcgggacccggcggaaccgcccgccggcggggagccggaggagcatctgctgctcctggtggtgcaccacatcgcggccgacggatggtcgctgcggatcatcgcgcgcgacgtggccgccgcgtacgccgcccgcgtggacggccggcggcccgcgcccgccccgccccccgtcgactacgtcgaccacaccctgtggcagcaccgggtgctcggcggccccgacgaggagggcggcccgctcggcgagcagctcgcctactggcggcggcagctggccgcgctgccgccggaactcgcgctccccgccgaccggccgcgcccggccgtctcctcccaccgcggcgaggacctggacttcgccgttcccgccgcggcggccgcacggatgcgggagctggcggggaccaccggcaccacgcccttcatggtcctccaggccgcgctggcggtcctgctgcaccggatgggcgcgggcacggacatccccgtgggcaccccggtcgccgggcgcacggacggggcggtggagggagtcgtcggactcttcgtcaacaccctcgtgctgcgcacggacctgagcgggtcccccaccttcagacagctcctggaccgcgtgcgcagcaccgccctggacgcctacgcccaccaggacgtgccgttcgagcggctggtggaggtgctcgcccccgagcgctccctggcccgccacccgctcttccaggtctccctcgccctgcagaacctcgacgacgcggcggcaccggcgggcgaactgcccgggctgcgcgccgaagcggtccgcacgcggcgggacggcgccaagttcgacctgtccttcgtgctcgccccgggcggcccggagggcggcgacatgcccggagtgctcacctacagcaccgacctcttcgaccgcgcgaccgcgcaggggctggtggaccggctgctgcgggtgctggacgaggtgctcgccgcccccgccaccccggtggggaaggtggacgtgctcctccccggcgaggcgcagcgggcgctggagcacggccgcggaccccggagcgggcacgtggcggacgaaccgctggcccgcttcgaggggtgggcggcggccacccccgacgcccccgccctgcggtggaacggcggccggctgacctacgccgagctggaccggcgggcgggcgcggtggcccgggtgctcctcgggcggggcatcggacccgaggacgtggtcgcggtggccgccccgcgccgcccggaggtggtggccgcgctgctgggagtgctcaagtccggcgccgcctacctgccggtggacgaggcgtggccggccgagcggcggcggcaggtgacggccgacgccggggcgcgcctgctgctggccccggggagcaccgacgccgcccgcgccgccctcgccccgcccaccgggccgggcacggaggtgctcggcctggcggacccggtcttcaccgccgccggcggctccgccctcccggcggtgcaaacccacccgcgcgcgctcgcctacgtcatctacacctcgggctccaccggccggcccaagggcgtcggcgtggagcgcggggcgctggccgactacgtggacggggccgtccgccgctacccggacgcggcgggcacggccctgctgcactcaccgctgaccttcgacctcagcggcaccgccctgttcaccccgctggccgcgggaggctgcgtcgtgctgggggaggtggaccgggaggcggaggagagccgggcgacgttcgtcaaggcgacaccgtcccacctgccgctgctggagcggcacccggggctgctggaggaggccggcaccctggtgctgggcggtgaggcgctcgacgggcgcgccctgcgcgactggcgcgccgcccacccgcgcgccacggtcgtcaacgcctacggccccacggaactcaccgtcaactgcgccgagcaccgcatcccccccggcggccccgtgcccgaggggccggtgccgatcggccgcccgttcgccggcgtccgcgcgatggtgctggacgcggggctggccccggtgcccccgggcgtggtcggggagctgtacgtcgcggggccgggagtggcccgcggctacctcggccgcccgggcctgaccgcggagcggttcctgccgtgcccgttcggggagccgggggagcggatgtaccgcaccggtgatctggcccgccggctgccgggcggtgaactggagtacgccggccgaacggacgagcaggtgaagctgcgcggcttccggatcgaactcgccgaggtggcgcaggccctggccgcggcggagtcggtcgcccgggcggtcgccgtcatacgggaggaccgccccggggaccggcggctgaccggctacgtggtcccggcggcgggagcccgcccgcaggaggacgaactgcggagcacggtggcccgcacgctgcccgagtacatggtgccctcgtccgtggtggtcctcgacgagctgcccaccacgccgcacggaaagctggaccggcgcgccctgcccgcccccgcgcaccgctcccgcggcggccggccgccgcgcgacgagcgcgaacgggccctgtgccggatctacgccgaagtgctcggcgtacccgaggtcggcgccgaggacgacttcttcgcgctcggcggccactcgctgctcgccacccggctggtcaaccggatcaggtcggaattcgccgacgagctggacgtacgggccgtgttcgaggcccgtacggtcgccgcgctggcagcccggctgcggaccagccgccctaacgcccgccccgcgttgcgacggatgtcgcggtcggagaactcgtgatgcttcccctttccctcgcccagcagagactgtggttcctccaccagatggacggccccagcgccacgtacaacatccccacggcgctgcggatgaccggcgcgctggacgtcgccgcgctgcgcgaggcgctgcgcgacgtcgtgcggcgccacgagacgctccgcacggtcttccccgacgccggcgacggcgcccggcagcacgtcctgcccgcggccgaggccgccgtggagctgaccgtcaccgggaccaccgaggccgaactgccggccgtcctggcccaggaggccggccacgccttcgacctggcccgcgaagtgcccctgagggcgcggctcctcgcgctcggcgaacgggaccacgtgctgtgcctggtgatccaccacatcgccagcgacggctggtcgcgcgccccgctcgcacgcgacctcaccaccgcctacgccgcccgcagcgagggccgcgcgccgcagtgggaggaactccccgtccagtacgccgactacaccctctggcagcgggagctgctcggctccgaggaggaccccgagagcctgctcagccgccagacggcgtactggaagcaggcgctcgccggtctgccggacgccatcgagctgcccttcgaccgcccccgcccgccgatcgccggccaccgcggcgacaccgtgccgatcaccctgccgccgcggacccacgagcggatcgccgcgctggccggccgccacggcgcgagcacgttcatggtggtgcaggcggcgctggccggcctgctgtcccggctcggcgcgggcacggacatccccctgggcacatcggtggccggacgcaccgacgaggcgctggaggggctcatcggcttcttcgtcaacaccctggtgctgcgcaccgacacctccgggaaccccaccttcgacgaactggtcgcaagggcccgcgagaccgccctggacgcctacgcccaccaggacgtgccgttcgagcggctggtggaggcactcgcccccgagcgctccctggcccgccacccgctcttccaggtgagcctgagcctccagcacgccaccgagcagacggcggtcctggacgggctggagatcgccccgctggacacgggctggcgggcggccaagttcgacctgtccttcgacctcctggagaagcacggccccggcggccgtccggacggcatcaccggcaccgtcgagtactccaccgacgtcttcgacgccgccaccgtccgcgggatcggcgagcgcctcgtccgcttcctcgaggccgcggtggacgcccccggggcacgcctgctctccgtcgacctgctctccgccggtgaacggcggcgcctgctggcggagttcggcgcatcgcggtccgggaccgacgggacggccggggccgaggaggagccggaaccggtctgcgacaccttcgcgcggcaggccgccgccaccccggaggccgtggccgtcgtcggcggcgacaccgcgctcacgttcgccgaggccgacgcccgggtctcccggctggcccggctgctgatctcccgcggggccggccccgagacccgggtggccgtctgcctgggccggaacgccctgtggccgacggccgtcctggcggtgctgcggagcggcgccgcctacgtgccgctggacccgcgctccccggccgagcgcctggccgccgtcgaacgcgacgccacccccctgatcgtgctcgccgagcgcggcaccgaggccgcggtcgccggcctcacggccccgctgctggtcctggacgacccgcggaccgaggccgggatcgaggcgcaggacccggccccggtcaccgacgccgaccgcaccgcgcccctcctgcccggccacgcggcgtacgtcatccacacctcgggctccaccggccggcccaagggggtcgtggtggaccaccgcggtctggcgcggctgctccaggcccaccgccgggtcaccttctcccgcattcgcccccacggagcgggacccgcccgggccgcccacgtctcgtccttctccttcgacgcctcgtgggacccgctgctggcgatggtcgccggacacgaactgcacatgatcgacgaggatctgcggctcgacccgccgggagtggtggcctacttccgcgaccgccgcatcgactacgtcgacctcacccccacctacttccgcagtctgctcgacgccggactgctggaggagaccgccccctgcccgtcgctgatcgccctgggcggcgaggcgatggacggcgagctgtgggagcggctgcgcgcggccgccccccgggtgacggcgatgaacacctacggccctaccgagaccgccgtcgacgcggtggtgaccgaactgggggacctgccgcacggcacgatcgggcggcccgtgccgcggtggcgggcctacgtgctcgacgccgggctgcagccggtcccgcccggcgtgctgggcgagctgtacctggccgggcccggggtcgcccgcggctacctggggcagcacggcctgaccgcggagcggttcgtggcctgcccgttcggggagccgggggagcggatgtaccgcaccggcgacctggcgcggtggctcgacgacggcaacctggtctgcgccggacgcggcgacgagcaggtcaagatccgcggcttccgcatcgagcccggcgaggtggaggcggccctgcgggagctggagggcgtcgcgcaggccgccgtggccgtccgcgaggacactcccggaacccgcaggctggtcggttacgtggtgggggccgacggcgccgaccccggcctgctccggcccgccgaggtgctggcgcgcctgcgcgaccggctgcccgaccacctggtgccgtccgcgctcgtacggatcggcgaactgcccgtcaacgccagcggcaagctggaccgggccgcgctgccggcgcccgaccccgcggccttccccgccggccggcaaccgcgcaccgacctggagcgggacctgtgcgcgctgttcgcggacgttctgggcaccgggagtgtcggcatcgacgacgacttcttcgtccggggcggcgacagcatcctctccatccagctggtcggcagcgcccgccgggccggcctggagttcaaggtccggcaggtcttcgagctgcggacccccgcgggcctggccaccgtggcccgccggaccggcgcgggacggcaggaggaccccggcgccgccgtcgggccgctgccgccgctgcccgtggtcgccgagaccctggcggccggcgggccggtcggcgagtacaaccagtcggtcgtcctcgcctccccgccgggcgccgggcccgacgacgtgcgcgacgcgctccaggcgctgctggaccggcacgacgcgctgcggatccacgccgccccggcggcggaacccggccgcctgtgggatttgagggtggagcgggccggcacggtcacggcggagcggtgcctgcgcaagatcgacgcggccgggatgtccgaggaggagctggcggaggcggtggccgccgaggccgtcgcggcccgggaggccctcgaccctgtcgccggagccctcgtcggggcgatctggttcgaccggggcggggagccgggccggctcgtgctggtgatccaccacctcgccgtcgacggcgtctcctggcgcatcctgctcggcgacctccgcgaggcgtggcgggcgctgcgggacggccgccgcccggagctcccccgcacgggcacctcgctgcgcacctgggccacccggctcgccgaccgggccgccgacccggccgtcaccgcccagctggaccactggacggccacgctcgccgacgccggccccgaggtgggcagccgcccgctggaccggacccgggacaccgcggccacctccgccgtcctgagcggcgagctgccggagcccgtcaccgccgcactgctgggcccggccccggcggccttccgcgccggggtgaacgacctgctgctgaccgccttcgcgctggccgtcaaccactggcggggcgaggagggcgagccggtcctggtggacctggagggccacggccgggcggaggacctggtgccgggggccgacctgtcccgtacggtcggctggttcaccagcgtgtacccggtgcggctggccgccggagcggtcaccgccgccgacctcgccgggcgcgccccggccgtcggcgacgcgatcaaacgggtcaaggaacagctgcgggcggtccccgacgaggggctggggtacggcctgctgcgccacctcaaccccgagacgtcccggcgcctcgcgcacggtgcccgggcgcgcttcggcttcaactacctcggccggttcgccgccgagcagggcgggggcgaggacggctggcagctgctcggcagcggcccggcgggccggcacccggacaccccgctcgaccacgagatcgaggtgaacgccgtcacggcggagggcccggacggaccgcggctgatcacccggtggacctacgccaccggcctgctgaccgaggaggaggtgcgccgcctcgcgcgctcctggtcgctggcgctgcacgcggtcgtcggccacgccaccggcgccggcgccggcgggctcaccccctccgacgtggccgtccccgacctcggccaggccgagatcgaggagctggagcggcgctgcggcaccgccctggaggacgtgctgccggtggcccccctccaggagggcctgctctaccacagcgtgtacgaccggcgcgccctggacgtctacgtcggccagctcgccttccgcctggacggcgagatcgacgaggacgccctgcgggcggcggccggggtgctggtcgcccgccacaccagcctgcggacgggcttccagcagcgggagtcgggccagtgggtgcagaccgtggccgccgcggcggagctgccgtggcgctcctgcgacctgcgcgccctggaggatgcgcccggggacgccggggccgcgcagcggcggctcgacgaactggccgcggccgaacgcaccgagaggttcgacctcacccgcccgccgctcgtccgcttcctcctggcccgcaccgcccccgagcagtaccggttcgtgatcaccacccaccacacgatcgtggacggctggtccatccccatcctgctgcgcgagctgctcgcgctctacggcggcgccccgctgccggacgcccccggccaccgcgcctacgccgactggctcgccggccgcgacctccgggcggcccgggaggcgtggacgcgggcactggagggcgtgggcgggccgaccctggtcgcccccggcgccccgcgcgtcggagagatccccgagtcggtgcggctgaacctccccgaggacgtctcggcgcgactgcggacgcgggcccgcgaggccggagtcaccctcaactccgtcgtgcaggccgcctgggcgctcgtcctcgcccaggagaccggccgcgacgacgtcaccttcggcatcaccgtctccggccgccccgcggaactccccggcgccgaggacatggtcggcatgctggtcaacaagatcccgctgcgcgtccggctccgcccggccgaaccgctgctggaactggtccgccggctggagaaggagcagctcgaactgctggagcaccagcacgtcccgctgaccgccctgcaccgctggagcgggctgcccgaactcttcgacaccaccatggtgttcgagaactacccggcggagatcaccgcgcgggaggcgcccttccgcgcgtcgggcacggccggctacagccgcaaccactacccggtcaccctggtcggggcgatgcgcgggagcgagctgaccgtccgcatcgactaccgccccgacctcttcggcgaggactgggcccgctccctgggccggagggtcgtcgccgcgctgaccgaggccgccgaccgccccgccgccccgtccggcacgctggacctgctcgacggcgaggagcgcgcccggctgctggaggactggggcgccggcggcgccccgcaggacgcctcgcgcggctacgtcgagctgttcgaggagcaggtcgcccgcacaccggacgcccccgcggtcacgtcgcccggcggcacgctgacctacgccgagctggaccggcaggcgaacggcgtcgcccggtggctggccgaccgcaccgcgggcaccggcggcgccgaggtctacgtgggcgtgctggccccgcgccgggcggaggcgctcgccgtcctgctcggcgtcctgaagtcgggcgccgcctacgtgccgctggacgagcagtggccggccgaacgcacccgcagggtgctggaggactgccgccccgcactcgtggtggccccggccggcagccggcccgacggcgtgcgggaggccggggcggaggtgctcgccgtggacccggccgccctcgcctcccgcggggcgcacgccccggccggcgacgaacgggtgcgccccgcggcgccgggcggcgccgcgtacgccatctacacctccggttccaccggccgccccaagggcgtggtgatcgaccacagcgccctgggcgcgtacgtcggcggcgcacgcggccgctaccccgacgcggccgggacctcgctggcccacacctcgctcgccttcgacctcaccgtcaccaccctgctcaccccgctcgccgccgggggcaccgtgcggctgggcgagctggacgagtccgcccagaccgccggggccaccctggtcaaggcgacgccctcgcacctgcccatgctgcgcgagctgcccggagtcctgccggacgggggcaccctgatcctcggcggcgaggcactgaccggcaagcagctgcgcccgtggctcgaactgcaccccgccgcgcaggtcgtcaacgcctacgggccgacggaactcacggtcaactgcaccgagttccggctgccgcggggggaaccggtcggcgacggaccggtgcccatcggccgcccgttccccggcgtgcgggcctacgtgctcggccccggcctgcgcccggtccccaccgggaccgtcggcgagctgtacgtgtcgggcacgggggtggcccgcggctacctcggccggccggggatgaccgcggagcggttcgtggcctgtccgttcggggggccgggggagcggatgtaccgcaccggcgacctggcccgctggcggcccgacgggaacctggagtacgccggccgcggcgacgaccaggtcaaactgcgcggtttccgcatcgagacggcggaggtcgcccgcgccctggagggccaccccgcggtcgccagggcagcggtggtgctgcgcgaggaccagccgggcgaccagcgcctggtggggtatctggtgccggtcgcgggggagggggtgccggatcgggaggcggtgtcggccgcggtcgcggcggtgctgcccgagtacatggtgccgtcggcgctggtggtgctggaggacgggttgccgttgacggccaacggcaagctggaccgggccgcgttgccggtgccggagttcgcgccggtgcgcggggtggggcgggcgccgcgcggtccgcgcgaggagatcctgtgcgggttgttcgccgaggtgctgggggtgcccggggtcggggtggacgacgacttcttcgccctgggcggccactccctgctggcgatcgtcgtgatcagccggatcagggccctgctcgacgtggacctggccatcgacgccctcttcgaggcgcccacggtggccgggctggccgcgcacctcgacggcccgcagcgccgccccggcgcggtgcgggcggtggtgccgcggcccgggcggctgccgctctcctacgcccagcagcgcctgtggttcctccaccagatcgaggggccgagcgccacctacaccgtcccgctggcgctgcggctgaccgggcccctggacgtggccgccctgcgcgccgcgctggcggacgtggtcgcccggcacgagagcctgcgcaccgtcttcgccgaggacgagcacggcccgcaccagatcgtcctgggaccgcggcagggcgcgcccggcctgcaggtggtccccaccaccgaggcccgcctgcgggccgacctggaagccgaggccgcccgccccttcgacctcgcacaggcaccgccggtgcacgcccggctcttcgccctcgacgagcgcacccacgtactgctgctggcggtccaccacatcgccatggacggctggtcggtccgccccctggtgcgcgacctggcggccgcctacgccgcccggcgccggggcgcgcccccggccctgcccgaactgcccgtgcagtacgccgactacaccctgtggcagcacgaggagctcggcaccgaggacgacccggacagcgcgatcgccgcgcaactgcggtactggcgggacgccctgcgcggactgccggaggaactggcgctccccgccgaccgccctcgccccgccaccccctcccaccgcgggggccgggtcggcttcaccgtcccgccggcggtgcacgggcgggtggccgagctggcccgggagcaccgggcgacgcccttcatggtggtgcacgcggcgctggcggcgctgctgacgcggttgggggcggggacggacgtgccgatcggctcgccggtggccgggcgcaccgacgacgcgctggaggacctggtggggttcttcgtgaacacgctggtgctgcgcaccgacacctcgggcgacccgagcttcgcggagctgctggagcgggtgcgcgccaccgacctggcggcctacgcccaccaggacctccccttcgaacggctggtggaggtgctcaacccggtgcgctcgctcgcccgccacccgctcttccaggtgctgctggccttcaacaacggcgcggtgcccgccgacggacccgccgaccgggcctcggacgtcctggtccggcccgtgacggtggagaccgcggcggccaagttcgacctgtcgctgtccttcaacgaggaccgggcggccgacggctcggcggcggggatccggggcgtactggagtacagcaccgacctgttcgacgagagcacggcccacaggacggtccggtacttcctccggctgctgggcgcggcggtcgagcagccccgcacaccgctgagcggccttcccgtcctgagcgagccggagcggcacgagctgctcgtccggcgcaacgacaccgcccgcgacctgccctggacctcgccgctgcggcgcttcgaggcccaggccgcccggaccccccgggccacggccctggtcgccggcgaggagcggatctgctacgccgacctcgacgcacgggccgaccggctcgccgggctgctgtcggacggcgccgcgggacggagcggaccggtcgcggtcgcgctgcggcgcggcgccctgctgccggtgacgctgctcgccgtctggaaggcgggactgcactacctgcccctggaccccggccacccgagggagcggctggcggacgtcctcgccgactgcgcgcccgcatgcgtggtcaccaccgcggacctcgccggcgacctccctcccggcccggccccgctgctcgtcctggacgacccggccaccgccgaacgcctggccgccgcgcccggcaccgcaccggccggggccgcgcacgcctggggccacccggacgacctggcgtacaccatctacacctccggctccaccggccgccccaagggcgtcatggtgacccgggcgggcgtggcgaacttcctcgccgacctgaccgagcggctggagctggggcccgacgaccggctgctggcggtcacgacggtctccttcgacatcgccgtcctggagctcttcgcccccctgctcaccggcggcgcggtcgtcctggccgacgccaccgcccagcgcgaccccgcggccgtgcggtccctgtgcgcccgcgagggcgtgacggtcgtccaggccacccccggctggtggcacgccatggccgtggacggcggcctggacctcaccggcctgcgcgtgctggtgggcggcgaggcgctgccggcgaccctggcccgcgccctcctggagcccggccgcgcgccgtccggcgaccgcctgctcaacctgtacgggccgacggagaccaccgtctggtccaccgccgcgcacatcaccgccgggaccccggaggcgcgcggcggctcggtgcccacggggacgccgatcgccaacaccgccgcctacgtgctggacgccgcgctccggcccgtgccggacggagtgccgggcgaactctacctggccgggaccgggctggcccgcggctacctcggccggccggggatgaccgcggagcggttcgtggcctgtccgttcggggggccgggggagcggatgtaccgcaccggcgacctggcccgctggcggcccgacgggaacctggagcacctcggccggaccgacgaccaggtcaaggtccgcgggttcaggatcgagctgggcgaggtcgagaaggccctggcggaggcccccggcgtcggccgggccgccgcggccgtgcgcccggatcccgccggctccgcccgcctggtggggtatctggtgccggtcgcgggggagggggtgccggatcgggaggcggtgtcggccgcggtcgcggcggtgctgcccgagtacatggtgccgtcggcactggtggtgctggaggacgggttgccgttgacggccaacggcaagctggaccgggccgcgttgccggtgccggagttcgcgccggtgcgcggggcggggcgggcgccgcgcggtccgcgcgaggagatcctgtgcgggttgttcgccgaggtgctgggggtgcccggggtcggggtggacgacgacttcttcgccctgggcggccactccctgctggccacccggctggtcgcgcggatccgcagcacgctcggcgtcgagctgggggtccgggaggtcttcgagacgccgacggtggccgggctggccgccgcactgtcccgggcgggggaggccgggccccggctgcgccccgccgacccgcgacccgggcggctgccgctctcctacgcccagcagcgcctgtggttcgtgcagcaactggagggaccgggcgccacctacaacatcccgctggcgctgcggctgaccgggcccctggacgtggccgccctgcgcgccgcactggcggacgtggtcgcccggcacgcgagcctgcgcaccgtcttcgccgaggacgagcacggcccgcaccagatcgtcctggccgccgccgacggccccgccccgctcgccggcccggtccgcaccgacgaggaggaactcccccgcctcctgcgggaggcggccgaccacgagttccggctggacgccgaaccgccgctgcgcacacacctgttcgccacggcacccgacgagcacgtgctgctgctggtcatgcaccacatcgccaccgacgcctggtcgcagcggccgctgatcgccgacctggcggccgcctacgccgcccgccgcgcgggccgggccccggcctggccgccgctgccggtcgagtaccccgactacgccctgtggcagcgggcccgcctgggggacgagcgggaggccggcagcgagctggccgcccagctggcctactggcgggacgccctggcgggctcccccgaggagctggcgctccccgccgaccggccccgtcccgccatcccctcccaccgcggggacagcgtgccgatcctggtcccgccggcggtgcacgggcgggtggccgagctggcccgggagcaccgggcgacgcccttcatggtggtgcacgcggcgctggcggcgctgctgacgcggctgggggcggggacggacgtgccgatcggctcgccggtggccgggcgcaccgacgacgcgctggaggacctggtggggttcttcgtgaacacgctggtgctgcgcaccgacacctcgggcgacccgagcttcgcggagctgctggagcgggtgcgcgccaccgacctggcggcctacgcccaccaggacctccccttcgaacggctggtggaactccgcgaccccgagcgctcgctcgcccgccacccgctcttccaggtggcgctgaacttcgacacggccgagacggccggcgcgcgcgacaccgcacccgaactggacgggctgaccgtgcgcagggaacggctcggcgtcacgacgtcgaagttcgacctcaccttcgcgctcaccgagacccgcacccgcgacggcggcgccggcggactgcgcggcgtgctggagtacagcaccgacctgttcgaccgcagcaccgcccggcacctggtggagcggctcggccgggtgctggaggccgtcgtggaggcgcccggcaccgctctcggcgagatcgacgtcctgctgccgggcgagcgcgaactcctggcgggcgcgtggagcgaacccgaccccgggccggtcaccaccgccggggccgccgcggacggcatccgcttcccggacctgttcgaggcgcaggccgcccgcaccccgcacgcgccggcggtccgcgacggcggccgggaggtcgcctacgccgagctgaacagccgggccaaccggctggcccggctgctcgccgggaggggagccggccccgaggacaccgtcgcggtcctgctgccgcgcggcgccgggctgatcaccgcactggtggcggtccagaaggccggagccgcctacgtccccctggacgccgagctgcccaccggtcggatcgcccacatgctggacgacgccaagccggtgctcaccgtgaccctcaccgggatgcgggacgcgctcccggccggggcgggccccgtggtctgcctggacgacccggccaccgaggccgcgctcgccgggctcgacggcgccgactgcaccgacgccgaccgccgcgcgccggccggggaccgcgatccggcctacgtcgtctacacctcggggtccaccggcacaccgaagggcgtcgtcgtcgagcagcggtccctcgccgccttcctggtgcgctcggccgcccggtaccgcggcgccgcgggaaccgtgctgctgcacggctccccggccttcgacctcacggtgaccacgctgttcaccccgctggtcgccggcggctgcatcgtggtggcggacctggacgcggcggagggcgacgccccgaaccggcctgacctgctgaaggtcacgccgtcccacctcgccttcctggacgggatcgcctcctgggcggcccctgccgccgacctggtcgtcgggggcgagcaactgaccggagcccggctggcccggctgcgcgcggcgcaccccgggatgcgcgtctacaacgactatgggcccaccgaggcgaccgtcagctgcgcggacttcgtactggagccgggcgacgaactgcccgcggacgccgtgccgatcgggcgccccctggcggggcaccggctgttcgtcctggacgagcgcctgcgcccggtgccggccggcgtccccggcgagctgtacatcgccggcgtgggggtggcccgcggctacctcggccggccggggatgaccgcggagcggttcgtgggctgcccgttcggggggccgggggagcggatgtaccgcaccggcgacctggcccgctggcggcccgacgggaacctggagtacctcggccgaggcgacggccagctgaaggtccgcggcttccgcatcgaaccgggggagatcgaggcggcgctgctcgaccgcccggagatcggccaggccgccgtcgtcctgcgcggggaacgcctggtcgcctacgtcgcggccccggaggcggagttcgacccggccgcgctccgggagggactcgccgcccggctgccgcggtacatggtcccggccgcgatcgtccggctggacgccctgccgctggcccccggcgggaagctcgaccacagggcgctgccggagcctccggcgcccgcggacgccccgcacgaccgcaggccgccgcgggacgcgtgggagcgcgtgctgtgcgaggcgttccgggaggtgctcggggtcgcggaggtcggggccgacgacgacttcttcgcgctcggcggcgacagcatcggctccatccagctcgtcggccgggtccgcagggcgggtggccggatgaccgtccgcgacgtcttcgaacggcggacgcccgccgcgctcgcggcccgctcccggcagagcggggcggccttcgaggtgctcggcggccgggccaccggcccggtgccgcccacgccgatcagctcctggctggccgaactcggcggcgcggccgagggctacaaccagtccgtgctgctgcgcgtcccggcccaggcggacgaggccgtcctcgtcggcgccctccaggcgctgctggaccaccacgacgcgctgcggatgcgggccgagccggcggccggccactggcggatggagatcggcgaggcgggcggcgtggacgcggccgcggtgctggagcgggtgccggcggcggacgtcccgcaggcggagctggaccggctggtccgcgcgcactgcgccgcggcccgcgaacggctcgccccgcaggagggcgccatgctgcgcgccgtctggttcgaccgggggccgcgggagccgggccacctcgcgctcgtcgcccaccacctggtcgtggacggggtgtcctggcgcatcctcaccgccgacctcggccgggcgtggcaggcggtcgccgacggccgggaggtccggctcgacccggtgggcaccccgctgcgggtctgggcgcagcggctggcggagctcgccgccgacccgcgccgcgccgaccggtgcgcctactgggaggagcaggcggcacggccctgggaggccggtcgcctcgacccggccgcggacgacaggagcaccgaggaggccctgtccctgaccctcccggccggcaccacccgggccgtgctgggctcggtgcccgccgcactgggggtgggggtgaccgaggtcctgctgggaacgttcgccgccgccgtgcggcggtggcgcccggcggaggccgcggacggcgtcacggtggacctggagggccacggccgcgaggaggaggtggtccccggggccgatctctcccgcacggtcggctggttcaccgccgcccacccggtccggatcccggccgccgggccggacgacgaccgggccggcgcgctgcgggcgctggccgggacgctggaccgggtgccggacgccggcctgggctacggcatgctgcggtacctcaacccgcggacccgggaacggctcgcctccctccccgcgccgcgcttcggcttcaactacctgggccggttcggcgacccgggcgcggaccgggacggggccgcggaggcccccgcctggtcgccggtgggcagcggggtcgcgggccagcccgcggggctcccgctcgcccacgagatcgaggtcaacgcggtcgccgccgacggccccgacggcccccgcctgatcgccacctggtcctgggccggccggctccaccgggagcaggacgtccgggagctggccgggctgtggttccgggaactggacgagctcgcctccgccgaacggtccccggccgccggccccccgcccccggcggacccagcccccctggtcgagctctccgacgccgaactcgaccagctcgaagcagagtggaaggccgactgatgcgccgatccctacaggacgtcctgcccctttccccgctgcaggagggcctgctcttccacagcgagtacgccggcgacgaggccgtcgacgtctacaccgtccagaccgaggtggaactgcacgggccgctggacgtgccggcgctgcgcgcggccgccgaggcgctgctgcggcgccacgacaacctgcgggcgggttttgcgacccgcgccctgaaggaccccgtgcagttcgtccccagggaggtcgagctcccctgggaggaggccgacctgcgcgcggccggcgatccggaggcggaggcggcacggcggctggacgagcaccgctggcgccgcttccggcccgccaagccgccgctggtgcggttcctgctgctgcgcacggcgcaggaccgccatcggttcgccctcaccaaccaccacatcctgctcgacggctggtcgatgccggtgctgctgcgcgagctcatgctgctctaccgcaccggcggcgacgcctccgccctgccgccggtgcgccgctaccgcgactacctggcctggctggaccgccgcgacgagcgggcggcgcaggacgcctggcggcgcgcgctggagggtctggaggcccccatcctcgtcgccccgcgggccgaccgggcggcggaggcgccgcagtggctggacttcgaactgcccgcggcggcctcggccggactgacccgggccgcccgcggcgccggcctcacgctcaacaccgtcgtgcaggggctgtgggccctgaccctcgcccgcaccaccggcagccaggacgtggtgtacggcgtggtcgtctccggccggccaccggaactggacggcgtcgagtccatggtcggcctgttcgccaacaccgtcccgctgcgggcccggatgcccgcggccgaaccgctgacggacttcctccggcggttgcagcgcgagcagagcgcgctcctggaccaccagcacgtgcggctggccgacatccagcgcctggtcggccagggcgagctgttcgactcggtgatggcgttcgagaactacccggccgggcccgcggaggagccccccggcgattcccccgccgcgccggggcgggtgcgcgcggtggcgtcgaggatgcgcgacgccatgcactacccgctcggcctgctcgcctcccccggcccgccggtgcggttccgcctgggccaccggcccagcgcggtgacgccgcgtctggcggctgccctgcgcgaccgcctgctgcggctcgtcgacgccttcctggctgccccggacctgcccctggggcggctcgacgtcctcgacgacgccgaacgggccctggtgctggagaagttcaacgacaccgcgcgcgaggtcgaggacaccaccgccaccgagctgttcctccggcaggccgcccgcacccccgggcggaccgccgtggagacggccgaccgcagcatcggctacggccggctcgccgaccgctccggccggctggcccgcctgctggtggagcgcggggcgcgggccgagcggttcgtcgccctggcgctgccgcgctcgccggaactggtcgaggccgcgctcgcggtgtggcagaccggcgccgcctacgtaccggtcgaccccggccacccggccgaccgggtggcccggctgctgcgggaggccgaaccgctcctcaccgtcaccaccgccgacctggccggccggctgccggcggacctcccgctgctggtcctggacgctccgcggaccgtcgccgcgctggaggaactgcccggcggcccgctgggcgacggcgagcgcccctcgccgccggacccggggaacgccgcctacgccatctacacctccggctccaccggacggcccaagggcgtggtggccacccaccggtccctcgtcggctacctgctgcgcggctcgcaggagtacccgtccgacggacgctccctggtgcactcgccggtctccttcgacctcacggtcggcgccctctacgtcccgctggtcagcgggggcacggtccgcctcgcctccctggacgacgagccggtcctgcgccccggcgaggcacccccggacttcgcgaaggtgacccccagccacctgccggtcctcgaagggctgccgcgggaggtcagcccgaccgcggcgatcaccttcggcggcgaacagctcaccggccggcacctgcggcggtggcgcgccgaccacccggacgtcaccgtctacaacgtctacgggcccaccgagacgaccgtgaactgctccgagcaccggatcgccccgcgcgccccggtcgccgacggcccggtgcccatcgggcggccgctgtggaacacccgcctgttcgtcctcggccccggcctggtcccggtgccggtcggcgtccccggcgagctgtacgtcgccgggtccggcctggcccgcggctacctccgcgacccgggcaggaccgccgagcgcttcgtggcgtgcccctacgccgccggggagcggatgtaccgcaccggcgacctcgtccggtggaacgaggacggcctgctggagtacctcggcagggcggacgaccagatcagcctgcggggcttccgggtggagcccggcgaggtggaggcggcgctggcggcccaccccgccgtgcgccgggccgcggtggtgatgcgggaggacgcggcgggggacgcccggctggtcggctacgtcgttcccgccggggaggacgccggggacggcgcgcccccctccgccccggccggatccgacaccgggctgcccaccgcgcagatcaccgagcacctgcgccggatgctgccgccctacatggttccctcgcacctggtcgaactgcccgcgctgcccgtcacgcccaacggcaagatcgaccgcgccgcgctgccggagccccccgccgcgggcgactccgccgggggagcgcccagatccccccgcgaggagatcctgtgcgggctcttcgccgacgtgctccggcgcccgcaggtctccatcgacgacgacttcttcgccctgggcggccactccctgctggccacccgcctggccagcagggtgcgggcggccctggacgtggagctgccggtgcgccggctcttcgagcaccccacggtgaggtccctgtccgcgctgctggactcccgcggcggcgaacgcccgccggtgaggccggcggagcgcccggagcgcgtcccgctctcgtacgcccagcagcggctgtggatcctgcaccggctcaccggccccgacgccacctacaacatccaccgggccctgcggctcgacggcgacctcgacgtccgggcgctggaggccgcgctgcacgacgtggccgaacggcacgagacgctgcgcaccgtcatcgccgagggcgccgagggcccgttccagaaggtgctgccggcccggcggacggacgagcgcctcaccgtcctgccggcggccgaggaggaggtggaccgcaccgtcggcgagctggcggcccaccgcttcgacctggaagccgaaccccccatgcgggcctggctgctggagaccggcccgcacagccgggtgctcgtgctggtgctgcaccacatcgccagcgacggctggtcgggcaggaggctcctgcgcgacctgttcaccgcctacaccgcacgccgcgcgggccgggccccgaactggcggccgctgccggtgcagtacgtggactacgccctgtggcagcggcggttcctcggcgatcccgcggaccccggcagcaccgcagccgcccagctggagtactgggagcggcagctggccggtctgccggaggagctgaggctgccggccgaccggccgcgtccggccgtcccgtcccgcaccggcggccaggtctggctgacgctgcccgcatccgtccacaccgccgtggtcgacctggcccggacgtgccgggcgagcgtgttcatggtcgtccaggccgccgtcgcagccttcctcacccggatgggcgccggggaggacatccccgtcggcaccccggtggccgggcgcaccgacgaggcggtggaggacctggtcggattcttcgtcaacaccctggtcctgcggaccgacacctccggcgaccccgcgttcgccgagctggtcggacgggtccgcgagaccgcgctggccgcctacgcgcaccaggacctgcccttcgagcagctggtggagcgcctgagcccggcccgctcgctcggccggcacccgctcttccaggtcgccctctcctgcaacaacaccgaggagcagctggggcgccagggctccccgccccccggactcgccgtcagcccccaccaggtggagaccgcgcggtcgaagttcgacctgatgttcaccttcctggagggccacggggaggacgggcggccggccgggatcgagaccgccctggagtacagcgccgacctcttcgacagggagaccgcgcaggacctgctggaggcgttcggccggatgctggcgctctgggcggcggacccgggcggccccatcggagcccgggagctgctcgcggccgacgagcggcacacggtcgtggccgagtggaacgccacccggcgcgcgggcctggtcgcgacgctgccggagatgttccaggagcaggtcgcccggactcccgacgcccccgccgtggagcacgccggccgcgggctgacgtacgccgaactcaacgcccgggccaaccggctcgccagggtgctggtccggcacggcgtcggccccgagcgccgggtggccctgctgatgccccgctccctcgggcaggtcaccgcgctgctggcggtgctcaaggccggcggcgcctacgtgccggtggaccccggccacccggaggagcgcatcgccttcatgctgcgcgacagcgcccccgcgctggtcctggcggccgagtcgtgcgcggcgggacgcggggagatcgccggggtcccggtcctggtgcccgacgacgggccggccggggcggagccggacgggccgtccgccgccgacctcaccgacggggaccggaacgcccccctgaccgccggcaacgccgcgtacgtcgtctacacctccggctccacgggccgccccaagggcgtggtgaccgagcaccgcggtctgctgtcgctggccgtggcgcagcgggagcggtacccggtgcgggccggcagccgtgtgctgcagctcgcgtcgccgtccttcgacggcgccgtgctggagctgctgatggcgttcgccaccggagggacgctggtcctggccgaccggccgctcctggccggggagctgctcggcgagaccatcgccgcgcggcggatcagccacgccttcattcccccggcggcgctgaccggtctcacgcccgagggactggactgcctgcgctgcctcgtcgtcggcggcgaggcggtcacggcctcggtcgtggaccgctgggcgcccggccggcgcatgctcaacgtctacggcccgaccgaggccaccgcggtcaccctgaccagcggagccctctccccgggcggaccggcgcccgccatcggcacgcccgtgcccaacacccgggcctacgtgctcgacgaccggctgcggccggtgccccccggggtgacgggcgagctctacctggccggcgcgtcgctggcgcgcggctacggcgaccgccccgggctcaccgcgacccggtacgtcggctgcccgttcggggagccgggggagcggatgtaccgcaccggcgacctggcgcgctgggaccgggaggggcgagtccactacgtgggccgcgcggacgagcagatcaagctgcgcggtttccgggtggagcccggcgaggtccaggcccggctcaccgagcacgccgcggtgcgggaggcggccgtcgtcctgcgggaggacgagccgggggagcgcagactggtggcctacgcggtgccggccgacggcctgccccggcccaccgccgcggaactgcgggcccatctggccgccctcctgccgccctacatggtgccctcggcctatctggtgctggacgccctcccggccaacgccaacggcaagctcgaccgggacgccctgcccgaaccggaaccgctcgccgaggagggcggccggccgccgagcgacgaacgggaggccgccctgtgcgaggtgttcgccgaggtgctggggcgcgagtggatcggtgccgacgacgggttcttcgagaacggggggcactcgctgctggccacccggctggtcacgcgggtccgcgagcgcctcggggtgcccgtcgccgcgcgggacctgttcgaggcgccgacggcggccggcctggccgagcgcatcgggcggggcgccgagcgccgcgccccggcgcccctgctgacgctgcgggggcgcggcgaccagccgccgctgttctgcgtccacccggccgtcggcctggggtgggcgtacgcgggcctcctccagcggctccccgcggacgtcccgctctacgcgctgcaggcccgcacacccgccgccggcggcggactgccgcgcagcatcgaggagatggccggcgactacgtccggctggtccgcgccgtccggccgcacgggccgtaccggctgctcggctggtcgctgggggcccacgtggcccacaccatggccggcctgctggagcgcgacggcgagcgggtggacctgctcgccgtgctggacgcctaccctccccaccgcacggggacgaccggacgggaggggacggaggccgagatcgtcgcggccaacctgcgggagtcgggattcgcctgggaggaggcggagctgcgcgacggacgcttcccgctggagcggttccgtgcccacctgcgccggatggacagctcgctcggccacctcgacgacggcgagttgacggcggccaaggacgtctacgtcaacaacgtacggctcatgcggtcccacacccccggacgcgtccgctgcgggatcgtgctgatgaccgcggagcgctcccgcagcctcgaccccggggcgtgggacgcgcacaccgaggagggcgtcgaggtgcaccgcgtcgacgccgcccacatgtccatgctcaccgaaccgacgtcggtcgccgaagtcggccgcgtcctgacccgccgactggactccctgcggggagccgacacgaagaaacgagaggtgtgaacgatgaccaaccccttcgacgacgccgagggcaccttccacgtcctggtcaacgacgagggccagcactcgctgtggccgaacttcgtggaggtcccggcgggctggcgggcggtggtggaggaccgcccccgccaggagtgcctggactacatcgaggagaactggaccgacatgcgccccaagagcctcatcgaggccatggaggcccacgagaaggccgcgaccgcggccgagtgaccgggccccgggcgggcggacccgacgggaccccgcccgcccgcggaccccggcgcggggcccggcgaccgtgccgggcccccgcgcggcgcacccgcacccggcggccgcttccccggcccgcgcaccgcacaccgaccgaccatccggtcctcagggccgccgacgaccctccgagggagccttcgatgccgaccacacggatcaacgggatcgccctggaccacgaccgcaccggcagcggcccgcccgtcctcctgatcatggggagcggcgccgccaagtcggcctggcacctgcaccaggtgcccgcgctggtcgccgagggcttcgaggccgtcacgttcaccaaccgcggcgtccctcccagcggaggcggccccggcttcaccctcggcgacatggcggccgacaccgtcggcctgatcgagcacctcggcatcggcccctgcgcggtcgtggggatgtccctgggggccagggtcgcgcgcgaggtcgcccggacccgccccgacctggtctcccgatgcgtcctcgtggcgccgcgggcccgctcggaccggatgagggccgcctgcaccgccgccgagatcgccctcgccgacagcggcgtcaccctgccgccgcgctaccgcgcggtggtgcgggcgatgcagaacctctcgccgcggacgctcgcggacgaccggcagatcgccgactggctggacgtcctcgaactggcggcggccgacgggcccggcctgcgcacccagctggagctcagcgccgccgacgaccgcggggaggacctggccggcatcaccgccccctgccgggtgatcgccttcgccgacgacatcgtggcgccgccgcacctggcgaaggagatcgcggacgccctgcccgaggccgactaccacgtcgtccccgactgcggccactacggctacctggagcggcccgaccgggtcaaccggctcatcaccgaattcctccgcgcaccccagaccacacagggatgaaagagcacaccatggaaccgatcactccctggcggcccgccgagatcagcccgggcagccactccctccccgccaccgccgacgccctggccgacttcctgcgggactccgagcggatcgccgggctcctggccgcccacaaggtgctggtcctgcgcggtttcggcgtgggcccgcaggagctggagaagatcatgccgctcctgctgccggaccgcctggcgtacgtcttcggcaactccccgcgcaccaaggtggggcgcaacgtgtacacctccacggagtacccgcaggagttcaccatctcgatgcacagcgagatgtcctacgccgcgcagtggcccgcccggctgctgttctactgcgagcgggcggccgggagcggcggcgccacaccggtggtggacaacgccgcctggtaccgggcgctggaccgggaggtccgcgaggccttcgcgggcggcctgcgctacacccagaacctgcacgggggacggggcctgggcaagagctggcaggacaccttcgagaccgaggaccggtccgaggtcgaggactacctctcccggagcggcgccacctggcagtggaacgcgcgcaacgggctgcgggtcagccacgtccggcccgcgacgatcgagcacccggagacgggggaaccgctgtggttcaaccagtccgaccagtggcacccggccacgctcggcgacgaggccgccgccgcgctgatggagatgctgcccccggaggagctgccccagtcggtgaccttcgccgacggcaccccgataccggccgactacgtgcggcaggtgcgcgaccgcggactggagcacgcggtggacaacgactggcgggccggtgacctgatgctcgtcgacaacgtccaggcggcgcacggccgcaggccgttcaccggtgaccgccgggtcctggtcgccatgtcggactagccggcgcgccgcggaccggcaccgcgggcggccgccgcccgccgccgcccacccccaacccccagccccaggaaggccgcacggatgagcatcgccctcgccgacgtggaaggcgtgaacaggcacgagaccgagttcctctacgacgagatcttcacccgccgcggttacctgccggaggtgctgcacctgccggaggaccccgtcgtcttcgacgtgggggccaacatcggcatgtacaccctcttcgtgaagtccgagagacccggtgccacggtccactccttcgaaccggtcccctcggtgtacgaggtcctgtgccgcaaccgggagcgccacggcgtggcggggctcgcctgcccctacggcctcgccgagagcgagcaggaggtcgagttcacccactacccgggctactcgaccatgtccacgcgcagcaccctggcggacaccgaggcggagaaggcgttcgtccgggaacaggtgcggaccgaccacctgcccgaggccgagcggatgctggacgaactcctggccttcaggttccgggagcagacggtgcgctgccggctccgtccgctctccgcggtcctcgacgagcaccccgtggaccggatcgacgtgctgaagatcgacgtgcagcgcggcgagcagcaggtgctgcggggcatcgaggaacggcactggccgctggtgcgccagatcgcgatggaggtgcacgacagccccggcggcgtcaccgccggccggctcgcagcggtgaccgacgggctggagcggcgcgggttccgcgtccaggccgtgcaggaggaccggtacgcgggcagcgaccgctactccgtgttcgccgtctcgcggcaccacggcggccgggacgcggcggggccctcctgaggcacccgccggccggggccccggcgcgaccgccgcgcgggacgcccgccggaccgcagacccggaccacccttccccaaccccctcggagggacagcatgaaccccgaaagccgcttcgaactgtccgacgccgagcgcgccgacgtcgcgctcctggcggaggagctgacgcgcacgccccccggcctggtggacgagcgggaatggctcgaccggtgccgcagcctctcctgccacctgcccgcccgcctccaggaccggctccgcgccttccgccacgaccccggccgcgcgggcatgctgctcatacgcaacctgcccgcggccgggtccgtgccggacaccccgcgggagggcgactcggtggaacgcagggcgacactgagcgcctcggtgctctgcgccgtctccatggaactgggcgaggtcgtcgcctaccgcaacgagaagcagggggcgctggtgcagaacgtggtgcccgtgcccggccgggaggaccagcagtccaacgccggctccgtcccgctggagatgcacaccgagaacgccttccacccccaccgccccgactacgtcgggctgctgtgcgtccgcagcgaccacgaccggaccgccggactccgggtggcctgcgtccgcgccgcgatggagcacctggacgccggaacccgcgagaccctgcggcgccccctgttcaccaccgaaccgccgccctccttcgagcgtccggacagcgggaccaagccgcacgccgtgctcaccggcgacgtggaggacccggacatccgcatcgacttccacgccacccacgcgacggacccgtggggcaggcaggccatggacgccctggccgacgccgtccgcgcggtctccgaggaactcgtcctggacccggccgatctggtgtacgtggacaaccgcgtcgcgctgcacgggcgtacggccttcaccccgcgctacgacggcgaggaccgctggctccagcgcgccttcgtccacctggaccaccggcgctcccgggccgtgcgctcgctgcacgggcgcgtgctgagctgatggccgcggacggagcgatccatgccgccggtctgcacaagcgcttcggagccgtccacgcgctccaaggcgtggacctgacggtggcccagggcgagatcatgggcctcctgggccacaatggcgcggggaagaccaccctcgtcaacatcctgtccaccctgacgccccccacgtcgggcaccgcctcggtcgccggcttcgacgtggccgggcgccccgaggaggtgcgccggcgcatcggcgtcaccgggcagttcgcctcgctcgacgagcagctctccggctacgacaacctcgtcctggtggcccggctgtgcggggcctcccgggcgcaggccgaggaccgggcgggcgagctgctggaggccttcgggctccgtggcgccgggcagcggaaggcggtgacctactcgggaggcatgcgccgccggctggacctggccctgggtctggtcgggcgccccgacgtgctgttcctggacgagccgaccgtcgggctggacctgcccagccgcatcggtctgtgggagatggtcgaggatctcacgcgcggcggtaccaccgtcctgctcaccacgcagtacctggaggaggcggaccggctcgccgaccgcatcaccgtcctgggagcgggccgggtcctggtctccggcacggcggccgagctgaagtcgcgggccggcagcggttccatctcgctcaggctcgaaccgcacggggatccggccgcggccgccggcgccctgcgccgggccgggttcccgcccagcgtggcggccgcccggcgcgagctgacggtgccggcgggcggctcggcggacctggccacggtgatccgggtgctggacaccgtcgggcagaacgtgaccgagatccgccactcggagccctccctggacgacgtctacctcgccctcaccggagcggagccccacggccccggcccggtggaggcggcgcgccggacggctcccccgaaggcgcaccggcccaccggcgacacgcaggagaccacgtgaacgcaccgcggacgatggcacccccggcccgccccgccgcggggccgcgcggcccgcgctggaggccgacgggcagagccgcgcagctgtggatcctcacggcgcgtcagatccgcctggtgtacgccgaccgcagggtcgtgctgttcagcgtggcccagccggtggtgatgctgctgctgatcagtcaggtcttcggcagcctcgcggaccgctccgtcctcccgcggggcgtgtcctacgtcgagttcctgctgccggccctgctggtcaccaccgggatcggcacctcgcagtccgcgggagtgggtctcgtgcgggacatggaaggcgggatggtgcgccgcttccgcgtcctcccgctgtcgctgccgctggtcctggtggcgcgctcgatcgccgacctgacccgctcggggatgcagctgctggtcctggtggccggcggccacctgctgttcggataccgggccgggggagggctggggggcctggtggcggcgctgctgctgtccaccctggtgatctgggccctgatctggatcttcatcgccctcgccgcgtggctgcgcaaggtggaggtgctctccagcatcggcttcttcgtcaacttcccgctgatgttcgcctccagcgcgttcgtgccgatcgaggtgctgcccggctggctggcggccgtcgccaccgtcaatcccgtgagctacgcggtggaggcgtcccgcggcctcgcgctgggagggcaggtcgggagcgaggtgcccgcggcgctgtgcgcgggcctcggcctgatgctggcgatgatgctgctcgccgcccgcgccttccgccggccgcccgacgagtgaccgcgccggcccgcaggggcggccgcgccggctcagagcgcgcggcggcgcctccggcgccaccacacgacgccgaccgccaggacggccgccacgcccagcagcgcccacaggatcctggtgaccacggtctcggcctcccgcacggaggccgagaccagcgaccccgccgacacgtagagcgcggaccacatcgcggccccggcgagcgaggccggcaggaagcggaagtagcgcaccgagcccactccggccgtcgccggggtgagcgtgcgcacgatgggcagcagcctggtcaggaagacggcggtcgccccgtaccggtggaagagcgcctgggcgcggtcccagtgctgctggccgatccgccgcaccaggcgcgtgtcccgcatccgctccccgtagcggattccgaggaagtagccgatgtggtcgccggccgaactgctgaccgccacgacgaggaagagcgccagcagggaacgggtcccctccgttccggcgctcagcaccaggaccgcgacctcaccggggacgaacatgcccgctccgaggcccgattccgcgaaagcgaacgccgaggccagtgcgaatctggaggccggatccatctccgacaccgctgtcagcacatcgtggatccatgccatggcagtcctgaaccgcctctcctcgctcgtggtgcccggtacggattctgctgtgcggggcgcggacaccggctccggcggcgcccgttccccggaactcccgcatccttctccgggaggaagtcgaaatgtctttcgggtggacgccgggtgacggggaccggtgcggcacggggtgctccggctttcgtgtggatccgcatcccgcgctcacggtggacagtagggcggcttcccggtttcgccggaaacacccccggccgatgggcgcgcgcccgggagaagggcgaatgcgcgccaatgtaccaggcggcccgccggcggacccgttcgtccggcccggccggaaccggccgcggcgcccgtgccccggccggttccggcgggaccggccccgcccgcggggcgcgggggcccaccggccggagccggcgggggcggaaatccccggggcatgtcggcctgcgccggaggtgattgatggaatgtcggattccgggtacgggattccgggggaacgcccgcggcggggttcaacggcgggcccgtccgattgcccgcggccggcactccggcgatatgggggattcgatccccccgaatcccatgtccggcgccctgtgcccgttgggcacggatgctcatgaatcgcggtgcccggaaatttccaacccaggtgaatcgcctcttccgtggagttcgcggcgccgacggcaagggcgcggttgcgccgcgcccagcggaggacgaccgatcacaatgccgcgtccaaagcgcccttgacgcggggatcgaactcctgacagggtgcaacggtgtcactgcggaccggactggccgggcaccggtgccccgaaattccgtcaatcgcgcacaccggtgccggcggatgggattgcgggtcgtttgcgagcagcggaggatatccgccccgcacgcggtacgggtggtcgacgatgaaacccatcgaatgaccggattggtggaaatgcaggcggatgcactggcggagacggatttctacttgccgtccatgaccctcgaagactatctgcgggacgcggtgccggcccacccggtcctgaaggcggccgtggacttcggccgcccgggcgccgacaaggcgttgagggcgctggccgcgacgaccacggaattcgactccgacgacaccggacgcggcgactcctatcgccgggcgcagcggaactcgtcggtccgctggcggggcatacggcagctcctggaactggccgccccctccgacgcggcggccccccacatcgtcctggacgtcctcggaggggacgggaccatcgcgcgcgccgtccacgaacacgcccccgacctgcgggaccgcgtgagcatcctgacgggcgacctctccggcgacatggtcgaacgggccctcgcccagggcctgcccgccgtccggcaggcggcggaccacctcttcctgggggaccgcaccgtggacgcggcgctgctcgcctacggaacccaccacatcgcgccgcaggacaggctcaacgcggtcaccgaggccctgcgcgtcgtcagggacgggggccgggtcgtcctccacgacttcgacgacgccagccccatggcgcgcttcttcaccgacgtcgtccacccccacaccacggcgggccacgactaccggcacttctcgcgcggatcgctggtcgagctcttcgaggaggccgggacaccggctcgcgtcgtcgacctgtacgacccgctggtcgtccgcggcgacacggaggaggacgcccgccggcgcatgtgcgagtacgtggccgacatgtacggagtcggggagtacttcgccgcgcagggcgggaccgacgcccgctggcggatcctggagcggtacttcgggcacgagggctacctggcgggcctgcccgcggaggtcgacttcacaccgcgccccgtcgtctaccgctcccgcggcgcctacgtcgccgaggtgccccgtgcggcgatggtcgccgtcgcgcggaagacggcatga

SEQ ID NO: 35 - protein, 573 aa, Streptomyces refuineus
MADPLLFNPRTYDPGHFDPETRRLLRATVDWFEQRGKRRLIEDYRTRAWPADFLAFAAEEELFATFLTPARESDGRRDRRWDTARIAALSEILGFYGLDYWYVWQVTVLGLGPVWQSGNAAARARAAELLSRGEVFAFGLSEKAHGADIYSTDMLLEPDGDGGFRAGGSKYYIGNGNAAGLVSVFGRRTDVEGPDGYVFFAADSRHPAYHVVRNVVDSSKYVSEFRLEDYPVGPEDVLHTGRAAFDAALNTVNIGKFNLCTASIGICEHAMYEAVTHARNRILYGRPVTAFPHVRRELTDAYVRLVGMKLFSDRAVDYFRSAGPDDRRYLLFNPMTKMKVTTEGEKVVDLLWDVIAAKGFEKDTYFAQAAVEIRSLPKLEGTVHVNLALILKFMRNHLLDPVEYAPVPTRLDPADDAFLFRQGPARGLGSVRFHDWRPAFDAHAHLPNVGRFREQADALCEFVATAAPDEEQSRDLDLLLAVGRLFALVVHGQLILEQAGPAGVDGDVLDELFAVLVRDFSAHAVELHGKDSATAPQQRWALDAVRRPVVDDARSARVWERVEALSGAYEMTP

SEQ ID NO: 36 - DNA, 1722 bp, Streptomyces refuineus
atggccgacccgctgctgttcaacccccgcacctacgaccccgggcacttcgaccccgagacccgcaggctgctgcgcgccaccgtcgactggttcgagcagcgcggcaagcgccgcctgatcgaggactaccgcacccgcgcctggccggcggacttcctcgccttcgccgcggaggaggagctgttcgccaccttcctcacccccgcccgcgagagcgacggccggcgggacaggcgctgggacaccgcgcggatcgccgccctcagcgagatcctcggcttctacgggctcgactactggtacgtctggcaggtcaccgtcctcggactcggaccggtctggcagagcggcaacgccgcggcccgcgcccgcgccgccgaactgctctcccggggcgaggtgttcgcgttcggcctgtcggagaaggcccacggcgccgacatctactccaccgacatgctgctggagcccgacggcgacggcggcttccgggccggcggctccaagtactacatcggcaacgggaacgccgcggggctcgtctccgtcttcggccgccgcaccgacgtcgaggggcccgacggctacgtcttcttcgccgcggacagccgccacccggcgtaccacgtcgtgaggaacgtcgtcgactcctccaagtacgtcagcgagttccggctcgaggactacccggtcggcccggaggacgtcctgcacaccgggcgcgccgccttcgacgccgcgctcaacaccgtcaacatcggcaagttcaacctctgcaccgcctcgatcggcatctgcgagcacgcgatgtacgaggcggtgacccacgcccgcaaccggatcctctacggccgccccgtcaccgccttcccgcacgtgcgccgcgagctgaccgacgcctacgtccgcctggtcgggatgaagctgttcagcgaccgagccgtcgactacttccgctccgcgggccccgacgaccgccgctacctgctcttcaacccgatgacgaagatgaaggtgaccacggagggcgagaaggtcgtcgacctgctgtgggacgtcatcgccgccaagggcttcgagaaggacacctacttcgcccaggcggccgtcgagatccggagcctgccgaagctggagggcacggtccacgtcaacctcgcgctgatcctcaagttcatgcgcaaccacctgctggacccggtcgagtacgcgcccgtgcccacccgtctggacccggccgacgacgccttcctcttccggcagggccccgcccgcggcctgggatcggtccgcttccacgactggcggcccgccttcgacgcccacgcccacctgcccaacgtcggccgcttccgggaacaggcggacgccctgtgcgagttcgtcgccaccgcggcccccgacgaggagcagagccgcgacctcgatctgctcctcgccgtcggccggttgttcgcgctggtcgtgcacggccagctgatcctggagcaggcggggccggccggtgtggacggggacgtgctcgacgaactgttcgccgtcctcgtgcgcgacttctccgcgcacgccgtggaactgcacggcaaggactccgcgacggcgccgcagcagcgctgggccctggacgcggtccggcgccccgtcgtcgacgacgcccggtcggcgcgcgtgtgggagcgcgtcgaggccctgtccggggcgtacgagatgacaccgtga

SEQ ID NO: 37 - protein, 601 aa, Streptomyces refuineus
VAHVSGPPADPPAGSHLVAAIRATAEADPERKAVGFVRDPEREGEEALRSYSWLDDRARRIAVLLRGARLGAGSRVLLLFPQSAEFAAAYAGCLYGGMVAVPAPLPTGTSLETARVAGIARDAGAGAVLTVSDTEAEVRRWAAETGLGDLPLFSVDELPDDTDPGEWREPEIRAGTVAVLQYTSGSTGSPKGVVVTHGALADNVRSLLSGFDLGTGARLGGWLPMYHDMGLFGLLSPALFSGGAAVLMSGSAFLRRPHLWPTLIDRFGVVFSAAPDFAYDYCVRRVEPEQVDRLDLSRWRWAANGSEPIRAETLRAFTKEFAPAGLPHDAMTPCYGLAEATLLVSLSAGELRTRRVDAAALENHRFVEAAAGRPSREVVSCGRPPALEVRVADPATGEPVTGDAVGEIQVRGASVAGGYWRKPEATAETFVTAADGSGPWLRTGDLGALYEGELYVTGRIKELLIVHGRNIYPHDVERELRAHHDELGAIGAVFSVPTEEGEAVVVTHEVVPSVRDDRGPALVTAVRATLAREFGLAPAGVVLVRRGRTPRTSSGKVQRRLAARLFRTGELAQVHADPGAHRLVAALREADGLRDAPASTT

SEQ ID NO: 38 - DNA, 1806 bp, Streptomyces refuineus
gtggctcacgtgagcggacccccagcagacccgccggccggctcccacctggtggccgcgatccgcgcgacggccgaggccgaccccgagcgcaaggccgtcggcttcgtccgggatccggaacgcgaaggtgaggaggcgctgcggagctactcctggctcgacgacagggcccgccgcatcgccgtcctcctccgcggggcgcggctcggcgcgggctcgcgcgtcctgctgctcttcccgcagtccgcggagttcgcggcggcctacgccggatgcctctacggggggatggtcgccgtccccgcgcccctgcccacgggaacctccctggagaccgcacgcgtcgccggcatcgcccgggacgccggggcgggcgccgtcctcaccgtctccgacaccgaggcggaggtccggcggtgggcggccgagaccggtctgggcgacctgcccctgttctccgtcgacgaactgcccgacgacaccgacccgggggagtggcgggagccggagatccgggccggcaccgtggcggtgctgcagtacacctccggctccaccggcagccccaagggggtcgtcgtcacccacggcgcgctcgccgacaacgtccgcagcctcctgtccgggttcgacctgggaaccggcgcccggctgggcggctggctgccgatgtaccacgacatggggctgttcgggctgctgagcccggcgctgttcagcggcggcgccgccgtgctgatgagcggcagcgccttcctgcgcaggccgcacctgtggccgacgctgatcgaccgcttcggcgtggtcttctccgcggcgcccgacttcgcctacgactactgcgtacggcgggtggagcccgagcaggtggaccggctcgacctctcgcgctggcgctgggcggccaacggctcggagcccatccgggccgagacgctccgcgccttcaccaaggagttcgcccccgcggggctgccccacgacgcgatgaccccctgctacggactggccgaggcgaccctgctggtctccctgtcggcgggcgagctgcgcacccggcgggtggacgccgcggcactggagaaccaccgcttcgtcgaggcggccgcgggccgcccgtcccgcgaggtcgtctcgtgcggccggcccccggccctggaggtccgcgtggccgaccccgcgaccggagagcccgtcacgggcgatgcggtgggcgagatccaggtgcggggcgcgagcgtggccggcggctactggcggaaaccggaggcgaccgccgagacgttcgtcacggccgcggacggctccgggccctggctgcgcaccggcgacctcggcgccctgtacgagggcgagctgtacgtcaccggccgcatcaaggaactcctcatcgtgcacggccgcaacatctacccgcacgacgtcgagcgcgaactgcgcgcccaccacgacgagctcggcgcgatcggcgccgtcttctccgtccccacggaggagggcgaggccgtcgtggtcacgcacgaggtggtcccgtccgtccgggacgaccggggccccgcgctggtgacggcggtacgggcgacgctcgcccgggagttcggcctggcaccggccggggtggtgctggtgcgccgcggccgcaccccgcgcaccagcagcggcaaggtgcagcgccgcctggccgcccggctcttccgcaccggggaactcgcccaggtccacgccgaccccggtgcccaccggctcgtggcggcgctccgcgaggcggacggcctgcgcgacgcccccgcgtccacgacatga

SEQ ID NO: 39 - protein, 99 aa, Streptomyces refuineus
MSLSPPSSSPPSSPPPSPPHDPDALRQWLREQCADCLGVPPASLATDVPLTDYGMTSVTGTALCGMVEDHLDVECDLSLLWQEQTIDGITSRLASRTAR

SEQ ID NO: 40 - DNA, 300 bp, Streptomyces refuineus
atgtccctgtccccgccttcttcgtccccgccttcttccccgcccccttctccgccgcacgaccccgacgccctgcggcagtggctgcgcgagcagtgcgccgactgcctcggcgtccccccggcatccctcgccaccgacgtccccctcaccgactacggcatgacctccgtcaccgggaccgccctgtgcggcatggtggaggaccacctggacgtcgagtgcgacctgagcctgctctggcaggagcagacgatcgacggcatcacctcccggctggcctcgcgcaccgcgcgctga

SEQ ID NO: 41 - protein, 6291 aa, Streptomyces refuineus
MLESPADRVAATSAQSGIWTAQRLRSDDRLYTCGLYLELDHVVEEVLGEAIGRAVADTEALRTAFGEDGDGALEQRVLARPPDTQTRLFRLDLGGDDRPRAEALDWMDRQQAEPWDLAAGDTCRHTLIRLGGHRTVLHLRYHHLALDGFGAALYLDRIAAVYRALRTGRETPPCTFAPLARLVEEDRAYRRSARHRRDADHWRTRFADLPRPTSLAGAAAPAAPAALRHTVRVSAADTAALGLRADRSGSTWPVFATAAVAAFLSRLAPGEEVVVGFPVTARVTPAAVRTPGMLANVVPLRIRVRQGMSFAALLDRTAAEIGATLRHQRHRTEDIGRALGLPPHGAQPAPTLVNVMAFAPVLDFGDCLSPVHQLSAGPVEDLAVNLLGTPGDGRELEITVAANPLLHSEDAVASLAARLAEFLARAGEHADAPIGRTRLLGAAEEAEALAAGRSPRRDLPARTLPELFARQAARTPDAPAVASDRTTWTYARLDAHAGRVARRLAARGVGPESIVALAVPRGVELAALVIGVQRAGGAYLPIDPEYPAERIGFLLRDARPALVVCEPGTDLPDTGCPQVPAGDLLDAGVRCAEAEEPAPGDLPADLPAYVVYTSGSTGRPKGVVVTHAGIAALAAEQIDRYRLGPGSRVAQLAALGFDVAVAELAMALTSGSCLVLPPHGLAGEELAEFLRSRRITTALTTASVLATVPPGDFPDLSDLATGGEQPPPPLIARWAPGRRMFNVYGPTEATVQATSGRCAAGGERMPDIGNTEAGVDAYVLDGALRPVPDGATGELYLRGRGLARGYLRRPGLTAARFVADPHTGTGERMYRTGDLVRRVPGEGRTVLEFVGRADDQVKIRGFRVEPGEVEAALAELDGVAQALVTVREERPGDRRLVGYLVPDPAGRDGSARGPDVERWRRLIAARLPAHLVPSALVELAEIPRTANGKVDRSALPAPGGTPPPAGRAPRNAREEALCALFAEVLGVEEVGADHDFFALGGDSLLAARLASRIRNRLGKAVTVREVFRAPTAAGLAEALGGEARADGRVRPVRPRPERVPLSAAQRRLWFIDELQGASAAYNIPTTLRFDGPLDVPALHAALGDVVDRHEALRTTVRPAAEDATGAAAAPEQHIAPPGGHRLPLPVRDIAPEELAGELRAAAGHVFDLTRDLPVRARLYRTAEREHVLLLLVHHIAADGASMGPLIGDLATAYTARLAGRAPDLPAPEVTYADFALWEHRGGEHAAAQAEGLDYWRRALAGLPDRIRLPADRPRSQEPVRRGGAARFEVPPALYARLAELAGSVRATPFMVLQTAVAVLLSRMGAGPDVPLGTPVAGRPDEALDEVVGCFVNTVVLRTDVSGDPTVAELLARTRDGDLAALAHQDVPFDRVVDAVNPVRSIARHPLFQVMLVLNGAEQRRGRARFPGLDSRIGAVDSGETKFDLSWHFTHRDGPERALEGTLVYAADMFGAATARRLTERLLGVLTAMADDPGRPVGSIDVLSAAEHRAVRAWGTGAAQDRTRRPEPVAGRIAAQAARTPGAPAVTEPGRVWTYAELDARANRLARALAARGVGAEDLVAVLLPRGADLVATLLGVLRAGASYLPLDTGHPSDRNRWAVSDAAPALVVTDGAHRGTLPGETGCAVLVLGGEDAEAELAGRAPTPPDETDLARPVAGANAAYTIHTSGSTGRPKAVVVTRDALDAFVERTVDTYGDALRGTSLLHSPVAFDLTVATLYGPPAAGGRIHVEDLDEAGIARWERECPAFLKATPSHLALLEEFGGSAAPGTVVLAGEQLLGARLDRWRARHPGTAVFNSYGPTETTVNCLEYRIAPGAETAPGPVPVGRPVAGVRVHLLDARLRPVAPGVTGELYVCGPGVARGYRGRPAATAERFVACPFGEPGERMYRTGDLMRWTPDGALLYEGRADAQLKVRGFRVEPGEVEAALLDLPGVREAAVTLVGGPGRGSGQAGGSAAPARLVGYVVGGAFDPAALLERLRVRLPDHMVPAALVELDALPLTPNGKLDRRALPAPDFGRHAGRRAPRGPREELLCTLFAEVLGLPEAGAEDSFFALGGDSIVSIQLVGRARRAGLHFTVRDVFEHPTAAGLAAVARAADPAGDPGTRPAPGLPPSGPLPYVPAAARLVARTGSIRARGADRFHQSVVLTAPADAGPDDVRRVLQTVIDHHGALRLRAAADRDGAPDGLVIGEPGSVAAADLLRCRDAAGLPEAALREAVEQEARQARDGLDPSTGSVLRAAWLDRGPDRGGLLVLVAHHLSVDGVSWRILLDDIRHAWSTPAGPAGGTPLPPEGTSLREWATRTAGAAAGAAVTGRLPHWRQTLAGLEDPDGEVVALEVRLDPAADTHGSARETAHRLPPDLTDALVRTAPAALRAEPGELLLAGYALAASRALGGRPVFVVETEGHGRQDALLPGIDLSRTVGWFTSVHPVRLRPGAGAARLLKETRERLRTVPDAGLGHDLLRHGGAAPSSGEGGRGLPRPQFGFNYLGRVAVAEAPAGTDPGGTWAFAGHSVAPQPPELPLAHEVELTVVLEDGPGGPVLAARWNASARCLSRARQDALAREWEKALRELVALAGTAGGGGLIPSETGAGGLDQDEIEECEAAADFEVADLLALAPAQEGLLFHSTFDDEAEDVYVGQLALELHGELSGARLREAAQGVLDRHDALRAAFLQRRSGEWIQAIAARAPVGWEEHDLSGPGGQERQRRLEELLAGQRTRRFDLSRPPLVRFLLVRTAADRHVLALTNHHLVLDGWSLPLVVRDLMALYGADGGAALPAARPYRDYLAWLGGQDRDAAREAWTRALAGLQPSLIAPNARRDGAAPLPHYRTMDPQVVSRLTAWARRHGVTLNSAVEAAWALLLGRLTGRDDVSFGIAASGRPTDLPGAAEIVGLLMNTVPVRVVLDPGEPLEALVRRVQREQAGLLDHQFVPLAQVQRWVGGGDLFDTTLVFENYPLDPAAGLTAGEAGGDGPRLHDARGHDSNHYPLSVTVGPAPDLQLRFTYRPDLFAPEWVEELAARFEQVLDTMAASGTTPAGRLGVLLPHERATLLGDWARGEAASGRECPVALFEEQAARTPDALALVEGGDGGLRLTYAEFDARANRMARFLTARGIGAEDLVGLVFPRGADLLTGLWGALKAGAAYLPVDVDYPAERIGLLLSDGAPALVLTTSAHAHLVPEAPGRQILCVDLPGPADELARAPEGPVTDRERPRPVGADTLAYVLYTSGSTGRPKGVAISRGSLAAHAVRSRDRYPDAAGVSLLHSPVAFDLTVTALFTTLVSGGTLLLAELDEHAQGAGVTFVKGTPSHVALLDELPGVLDATGERPGTLVLGGEPLTGEMLERWRARHPQARVFNDYGPSETSVNCSDLVFEPGDEVPAGLLPIGRPLPGNHMFVLDHLLQPVPVGVVGEIYVSGVGVARGYHGRPGLTAERFLPCPFDAPGARMYRTGDLGRWRPDGIMECLGRTDDQVKVRGFRVELGEVEAALAARPDVARATVVVREDEPGDRRLTGYVVPEGGPEAGLDTAAVLRDLAAQLPEYMVPAAVVVLAELPRTENGKLDRRALPTPEYGTRSAGRAPRTAAETALCALFAEVLGVPGATVDDDFFALGGHSLLAVRLAGRIRAELGLRLDIRTIFDRRTVADLLADPQIAAQLTDGEVPGAPARPAEPAPGGQPPAGERGGAGAGPERLPLSPAQRRLWFLNRYDREAGGYHISVALRLTGDLDVGALHAALGDLAARHESLRTVFREDEEGPYQVVLPAAPSPAPAAVPASARELDALVREAVRRPFDLAEDTPLRHTLFALPDREHVLLLVIHHIAADGWSMGPLARDLAAAYRARAAGDAPRWPAPAPSHADHVLRRHRAPEHGGDAGDPADHRLAHWAEELRGLPDELPLPYDRPRPTTPPGYAERIGFRIDAGLYRDVLALAARHRATPFMVLHAALAALLTRLGAGTDIPVGTPSAGRDRPETADLVGFLVNTLVLRTDTSGDPTFGELLDRVRETDLRAYTHQDVPFERLVEAVNPARSPSRHPLVQTMLTLDNAAQGALEHLLDLPGVRAELLPTAEGTAHTDLDLTFAETGSAPPAGGTGLDGTLQYRPDLFDRATAQALVERFVALLRTVTREPGLRLGRLDVTTGEERRRLVEEDAAARRARAETTVTDLPALFAAWAERTPSAPALTDGGTTVDYAELDARSNRLARALLELGVGPEDFVALAVPRSADLVVAVLAVLKSGAAYLAVDPDYPAERTSYILGDCRPAAVLSTTAVRAALHGTVGEAAGEVPWLLLDSPRTRAAAAGLSAAPVTDADRRSPLLPDHPAYTIYTSGSTGRPKGVVVSHANVSRLLDVCRSAVDFGRDDVWTLFHSSAFDFSVWEMWGALAHGGRLVVVPHDVARSPRDLLELLGRERVTVLSQTPSAFLQLLRAETERGVPAEATAALRYVVFGGEALDTAQLAPWRGRPVRLVNMYGITETTVHVTHLELDDAAVERGGSLIGSPLDDLRAHVLDERLRPVPSGVVGELYVAGPGLARGYRQRPGLTAARFVADPSDAGGRMYRTGDLVRRAPDGGLHYVGRSDAQVKLRGYRIEPGEVEAAARRHPDIGQAAAVVHGDGPDDRYLVCYAVPDGDADPDPHEVRAHLAGALPGYMVPAAVVLLPALPLTPNGKLDRRALPAPDRAALATGGAPAGPREEALCAAFADVLRVEEVSRDADFFALGGHSLSAVRLISRIRSALGVEIGIRTLFEAPTPAALARRLDTAGAGRPRLVPQRRPHRVPLSSAQRRLWFLGELEGPGATYNIPLALRLRGPLDVGALRAALADVVARHEALRTVFPAENGVPHQHVVAPEEAAPGPAVVDVAEEELPAALAEACAYAFTLTEDLPLRAVLLRTGPTDHVLSLVLHHIAGDGWSLAPLARDLSTAYAARLEGRAPRWRPLPVQYADFTLWKERLLGEADDPDSLFARQLAFWRDTLAGAPEQIELPTDRPRPAMESHRGAIHRFTLPARLRDRLRALAHSRQATLFMALQAGLAALFAKLGAGRDIVLGTPVAGRGDEAVDDLVGFFVNTLALRTDLGGDPTFEELLDRVREADLSAFAHQDIPFEQLVEALNPTRSLSRHPVFQVLLALQNNELGEAVMPGLEVTVERPAQVAAKYDLFVNLVESRDPAGGATAIEGAVEYATDLFDAGTVARLAERYQDLLLAVTEEPATRLSRIPVLSGAERGMLAAEWDGTAAGPAEDVADLFRARATATPEAVAVRCAGESLTYAELGERADRVAAALAGRGAGPERRVAVCLPRTADLVACLLGVLRAGAAYVPLDPEYPDERIAAILSDTRPVALLTTADCRPAITAAAAACGAATLLAADAAQGAGPLPEVPAPLPDQAAYVLHTSGSTGRPKGVVVSRGNLANLLADMRERLRLTAGDRLVAVTTVSFDIAALELFLPLVGGAELVLADRGTARDPEALAALLTGSGATILQATPTTWQLLAETAPDALRGLRKLVGGEALPASLASRLHGLGGELVNVYGPTETTIWSTAAHLDRATGSAPPIGRALRNTRAYVLDEWLDPVPAGVPGELYLAGAGVARGYLGRGALTAERFTADPFGAPGSRMYRTGDLVRRRADGELEFLGRTDHQVKVRGFRIELGEIETALGAHPDVSGAVVVARGASGPAPAPDDGGTAGPPRQLVAYVVAEPDRAGHDGSRERARLDEWRETYDTLYDNSEPTPLGRDFGIWRSSYDGRPIPLEEMLQWRAATVDRIRALRPARLLEIGVGTGLLLSELAPDCTAYHGTDLSARVIETLHEQVAAEPALKEKVELHVRPAHDFTGLRRGFYDTIVLNSVVQYFPGADYLSRVLRGALDLLEPGGRLFVGDVRSLALLRAFRASVEIGDAAAGDAPGPVLAAADRRTATEKELVVDPGYFARLRRETGEPLVLDVRVRRGRPLNELTRYRYDVLLAKPEAGTAAPAPAAEMRWAEEVGDRARLAEVCAAHRGALRVTAIPNARVRRETAALAALEDGRPLAAARRLLDGPAGGVDPEDLYDVAAAAGRTAWVCWSAEGPPDTVDLVLAPADGGGAAEVAPPAELWPYEPDADRPQTNDPSAALRNRELAAGLRAYLAGRLPDYMVPSAVVVLGALPLTANGKVDRAALPDPDPAGAAGGRPPRTPREELLCRLFADLLGLSRVGTEDSFFSLGGDSILSVRLVSRAREQGLPLTTRDVFEHHTVAALAAALDGREPEQTAADGRPDPAAGPRPISAEELAELEEELGADWEEMQ

SEQ ID NO: 42 - DNA, 18876 bp, Streptomyces refuineus
atgttggagtccccggcagaccgcgtggccgccacctcggcccagtccgggatctggacggcacagcggctgcgctcggatgaccggctctacacctgcggcctctacctcgaactcgaccacgtggtggaggaggtgctgggcgaggcgatcggccgtgcggtcgccgacaccgaggcgctgcgcaccgccttcggggaggacggggacggcgcgctggaacagcgcgtgctcgcgcggccgccggacacgcagacacggctgttccggctggacctgggcggagacgaccggccccgcgccgaggccctggactggatggaccggcagcaggcggaaccgtgggacctcgccgccggcgacacctgccggcacaccctgatccgcctcggcggccaccgcaccgtcctgcacctgcgctaccaccacctcgccctggacgggttcggtgccgcgctctacctggacaggatcgcggcggtgtaccgggcgctgcgcaccggccgggagacgcccccctgcaccttcgcgccgctggcccgcctcgtggaggaggaccgcgcctaccggcggtccgcccgccaccgcagggacgccgaccactggcggacgcgcttcgcggacctcccccgccccaccagcctcgccggcgccgccgcgcccgccgcgcccgccgcgctgcgccacacggtccgcgtgtccgcggccgacaccgccgcactgggcctgcgggcggaccggagcggcagcacctggccggtgttcgccacggccgcggtggccgccttcctgagccgcctcgcgccgggggaggaggtcgtcgtcggcttcccggtcaccgccagggtcacgcccgccgcggtgcgcacgccggggatgctggcgaacgtcgtgccgctccggatccgggtgcggcaggggatgtcgttcgccgcgctgctggaccggaccgcggccgagatcggcgccacgctgcggcaccagcgccaccgcaccgaggacatcggccgggcgctcggcctccccccgcacggcgcccagccggccccgaccctggtcaacgtcatggccttcgccccggtgctcgacttcggcgactgcctctcgccggtgcaccagctgtcggccggcccggtcgaggacctggcggtcaacctgctcggcacccccggggacggccgggagctggagatcaccgtcgccgccaaccccctgctccactcggaggacgcggtggcgtcgctggccgcgcggctggcggagttcctggcgcgcgcgggcgagcacgccgacgccccgatcggccggacacgcctgctcggcgcggcggaggaggccgaggcgctggccgccgggcggagcccgcgacgggacctccccgcccgcaccctgcccgagctcttcgcccggcaggccgcccgcacccccgacgccccggcggtcgcctcggaccgcacgacctggacgtacgcccggctcgacgcgcacgccggcagggtggcccggcggctggccgcccggggcgtggggccggagagcatcgtcgccctcgcggtgccgcgcggggtggagctggcggcgctggtcatcggagtgcagcgggccgggggcgcctacctccccatcgacccggagtacccggccgagcgcatcgggttcctgctgcgcgacgcccgccccgccctggtggtctgcgagcccgggacggaccttccggacaccgggtgcccgcaggtgccggccggcgacctcctcgacgccggggtgcggtgcgcggaggcggaggaaccggcgcccggggacctcccggcggacctgcccgcctacgtcgtctacacctccggctcgaccgggcggcccaagggggtcgtggtcacccacgccggcatcgccgccctggcggcggagcagatcgaccgctaccggctgggccccggctccagggtggcgcagctcgcggccctcgggttcgacgtcgcggtcgccgaactcgcgatggcgctgacctcgggaagctgcctcgtcctcccgccgcacggactcgccggcgaggaactggccgagttcctgcgcagccggcgcatcacgacggccctcaccacggcctccgtgctggccacggtgccccccggcgacttccccgacctgtccgacctggccaccggcggcgagcagcccccgcccccgctgatcgcccgctgggcgcccggccggcggatgttcaacgtctacgggccgaccgaggcgaccgtccaggccacctccggacgctgcgcggcgggcggggagcggatgccggacatcgggaacaccgaggcgggcgtggacgcctacgtcctggacggggcgctcagacccgtgcccgacggggcgaccggagagctctacctgcgcggcagggggctggcccgcggctacctgcgccgccccggcctcaccgccgcacgcttcgtcgccgacccccacaccgggacgggcgagcggatgtaccggaccggggacctggtgcgccgggtgcccggggagggccgcaccgtgctggagttcgtcggccgggcggacgaccaggtgaagatccggggtttccgggtggagccgggcgaggtggaggcggccctcgccgaactcgacggggtggcgcaggcgctggtgaccgtgcgcgaggaacggccgggcgaccgcaggctcgtcggctacctggtgcccgaccccgcgggccgggacggctccgcgcggggcccggacgtcgagcggtggcggaggctgatcgccgcccggctgcccgcccacctggtcccctcggcgctggtggagctggcggagatcccgcgcaccgccaacggcaaggtggaccgctcggcgctgccggcccccggcggcacgcccccgcccgcgggacgggcaccgcggaacgcccgcgaggaggccctgtgcgcgctcttcgccgaggtgctgggcgtcgaggaggtcggcgccgaccacgacttcttcgccctgggcggcgactccctgctggccgcccggctggcgagccgcatccggaaccggctggggaaggcggtcacggtacgggaggtcttccgggccccgaccgccgcaggcctcgcggaggcgctcggcggcgaggcgcgggcggacggccgcgtccgtccggtccggcctcgcccggagcgggtgccgctgtcggccgcgcagcgccggctgtggttcatcgacgaactccagggggcctcggccgcctacaacatcccgaccaccctgcgcttcgacggaccgctggacgtccccgcgctgcacgccgcgctgggcgacgtggtggaccggcacgaggccctgcggaccaccgtccggcccgcggcggaggacgccaccggggcggccgccgcacccgagcagcacatcgcccccccgggcggccaccgcctcccgctgccggtgcgcgacatcgcccccgaggagctcgccggggagctgcgcgcggccgcgggccacgtcttcgacctcacccgggacctgccggtacgcgcccggctctaccgcaccgccgagcgggagcacgtcctgctgctgctcgtccaccacatcgccgccgacggcgcgtcgatggggcccctgatcggggacctggctacggcctacacggcccggctcgcgggccgggcccccgacctccccgcgccggaggtgacgtacgccgacttcgcgctgtgggagcaccggggcggggagcacgccgcggcgcaggccgaggggctcgactactggcgccgggccctggccgggctgccggaccggatccggctccccgccgaccggccccggtcgcaggagccggtccgccggggcggagcggcacggttcgaggtgccgcccgcgctgtacgccaggctggcggagctggccggaagcgtgcgcgccaccccgttcatggtgctgcagaccgcggtcgccgtcctgctgagccgcatgggcgccggcccggacgtccccctgggcacgcccgtggccggccgcccggacgaggcgctcgacgaggtcgtcggctgcttcgtcaacaccgtggtcctgcgcaccgacgtctcgggcgacccgaccgtggccgagctgctggcgcggacgcgggacggcgacctcgcggccctcgcccaccaggacgtgccgttcgaccgggtcgtggacgcggtcaaccccgtgcgctccatcgcgcggcaccccctcttccaggtcatgctcgtcctcaacggcgcggagcagcgccgggggcgggcccgcttccccggcctggacagccggatcggggcggtggactccggcgagacgaagttcgacctctcctggcacttcacgcaccgggacgggcccgagcgggcgctggagggaacgctcgtctacgccgccgacatgttcggcgccgccaccgcccgccggctcaccgagcggctgctcggcgtgctgaccgcgatggccgacgaccccggccggccggtcgggtccatcgacgtcctcagcgccgccgagcaccgcgcggtgcgggcgtggggcaccggcgcggcccaggaccgcacccgccgccccgagccggtggccgggaggatcgccgcccaggcggcccgcacccccggcgcgcccgcggtgaccgaacccggccgggtgtggacgtacgccgaactcgacgcccgcgccaaccggctggcgcgcgccctggccgcccggggcgtgggcgccgaggacctcgtcgccgtgctcctgccccgcggggcggacctggtcgccaccctgctgggagtgctgcgggccggcgcctcctacctcccgctcgacaccgggcacccgtcggaccgcaaccggtgggccgtctcggacgccgccccggcgctggtggtgaccgacggcgcgcaccgcggcacgctccccggggagaccgggtgcgccgtgctggtcctgggcggggaggacgccgaggccgaactggcgggccgcgcccccaccccgccggacgagaccgacctcgcccggccggtggccggggccaacgccgcctacaccatccacacctcgggttcgacgggccgccccaaggccgtcgtcgtcacacgcgacgcgctggatgcgttcgtcgagcgcaccgtcgacacctacggggacgcgctgcggggcacctccctgctccactccccggtcgccttcgacctcacggtcgccaccctctacggaccgccggccgccggcgggcggatccacgtggaggacctcgacgaggccgggatcgcgcggtgggagcgggagtgcccggccttcctcaaggccacgccctcccacctggcgctgctggaggagttcggcggctccgcggcccccggaacggtcgtcctggcgggcgagcagctcctgggcgcgcggctggaccgctggcgggcccgccaccccggcaccgccgtcttcaacagctacgggccgaccgagaccaccgtcaactgcctggagtacaggatcgccccgggcgcggagacggccccggggcccgtgccggtgggccgcccggtggcgggcgtccgggtgcacctgctcgacgcccgcctccgcccggtcgccccgggtgtgacgggcgaactgtacgtctgcgggcccggggtcgcccgcgggtaccgcgggcggccggcggccaccgcggagcggttcgtcgcctgcccgttcggggagccgggggagcggatgtaccgcaccggggacctgatgcggtggaccccggacggcgcactgctctacgagggccgggccgacgcccagctgaaggtgcgcggcttccgggtggagcccggcgaggtggaggccgcgctgctggacctccccggcgtgcgggaggcggccgtgaccctcgtcggcgggcccggccgggggtccggccaggcgggcggctccgccgcccccgcccgcctggtcggctacgtcgtcggcggggcctttgacccggccgccctcctggagcggctgcgcgtccggctgcccgaccacatggtgcccgccgcgctcgtggagctggacgccctgccgctcacccccaacggcaagctcgaccgccgggccctgccggcgcccgacttcggccgccacgcgggccgccgcgctccgcgcggaccgcgggaggagctgctgtgcacgctcttcgccgaggtgctggggctgcccgaggccggcgccgaggacagcttcttcgcgctcggcggcgacagcatcgtcagcatccagctcgtcggacgcgcccgccgggccggactgcacttcaccgtgcgcgacgtcttcgagcaccccacggccgccgggctggccgccgtggcccgggccgccgacccggccggggacccgggcacccggcccgcgccgggacttcccccgagcgggccgctgccgtacgtcccggccgccgcgcggctcgtcgccaggaccgggtcgatccgcgcccggggcgccgaccggttccaccagtcggtggtcctcaccgcccccgcggacgccggcccggacgacgtccggcgcgtgctgcagacggtgatcgaccaccacggggcgctgcgcctgcgggccgccgcggaccgcgacggagcgccggacggcctggtgatcggcgaaccggggtcggtcgcggccgcggacctgctgcgctgccgcgacgccgcggggctgccggaggcggcgctgcgggaagcggtggagcaggaggcccggcaggcccgggacggcctcgacccgagcacgggatccgtgctgcgcgcggcctggctggaccgcggcccggaccggggcggcctgctggtgctggtggcccaccacctgagcgtggacggcgtctcctggcggatcctgctggacgacatccgccacgcctggagcacgcccgccggccccgccggggggacccccctgccgccggagggcacctccctgcgggagtgggccacccggaccgccggagccgccgccggggccgccgtgaccggccggctcccccactggcggcagaccctggcgggcctggaggacccggacggcgaggtggtcgccctggaggtgcggctcgaccccgccgccgacacccacggctcggcgcgcgagaccgcgcacaggctgccgcccgacctgaccgacgcgctcgtccgcaccgcgccggcggcgctccgcgcggagcccggtgagctgctgctggccgggtacgcgctggccgcctcccgggccctgggcggccggcccgtgttcgtggtggagaccgagggccacggccggcaggacgcgctcctgccggggatcgacctgtcccgcaccgtcggctggttcacctccgtccatccggtgcggctcaggcccggcgccggggccgcgcggctgctgaaggagaccagggagcggctgcgcaccgtgccggacgccgggctgggccacgacctgctccgccacggcggcgcggcgccgtcctccggggagggcggccgcgggctgccccgcccgcagttcggcttcaactacctcgggcgggtggccgtggccgaggcccccgccggcacggacccgggcgggacgtgggcgttcgcgggccacagcgtcgccccgcagccgcccgagctgccgctggcgcacgaggtggagctgaccgtcgtcctggaggacggccccggaggaccggtcctggcggcgcgctggaacgcctccgcccgctgcctgtcccgggcgcggcaggacgcgctggcgcgggagtgggagaaggccctgcgcgaactcgtcgccctggccggcaccgccgggggcggcggcctgatcccctcggagaccggcgccggcggcctggaccaggacgagatcgaggagtgcgaggcggcggcggacttcgaggtcgccgacctgctcgcactcgcgcccgcccaggaggggctgctcttccacagcaccttcgacgacgaggcggaggacgtctacgtcggccagctggcgctggagctccacggggagctgtcgggcgcccgcctgcgggaagccgcccaaggcgtcctcgaccggcacgacgcgctgcgcgcggccttcctccagcgccgctccggcgagtggatccaggcgatcgccgcacgggcgccggtcggctgggaggagcacgacctgtccggaccgggcggacaggagcggcagcggaggctggaggagctgctggccggacagcgcacccgccggttcgacctctccaggccgccgctggtgcgcttcctgctcgtgcggaccgcggcggaccggcacgtcctcgccctgaccaaccaccacctggtgctcgacggctggtcgctgccgctggtggtgcgcgacctcatggcgctgtacggggcggacggcggcgcggccctgcccgccgcgcggccgtaccgcgactacctcgcctggctcggcgggcaggaccgcgacgcggcccgggaggcgtggacacgggcgctcgccgggctccagccctcgctgatcgccccgaacgcccgccgcgacggcgcggcgccgctcccgcactaccgcaccatggacccgcaggtcgtctcccgcctcaccgcttgggcccggcggcacggcgtcaccctcaactcggcggtcgaggcggcgtgggcgctcctcctgggccggctcaccggccgggacgacgtgagcttcggcatcgcggcctccggccggcccaccgacctgcccggcgccgcggagatcgtcggcctgctgatgaacaccgtgccggtgcgcgtcgtcctggaccccggcgagccgctggaggccctcgtccggcgcgtgcagcgggagcaggccggcctgctggaccaccagttcgtccccctggcgcaggtgcagcgctgggtgggaggaggcgacctcttcgacaccacgctcgtcttcgagaactacccgctggaccccgccgccggcctcaccgccggcgaggccggcggcgacgggccccggctgcacgacgcgcgcggccacgacagcaaccactacccgctcagcgtcaccgtcggccccgcccccgacctccagctccgcttcacctaccgccccgacctgttcgcaccggagtgggtggaggagctggcggcgcggttcgagcaggtgctcgacaccatggcggcgtccggcaccaccccggcgggccggctgggcgtcctgctcccgcacgaacgcgccacgctgctgggcgactgggcgcgcggcgaggcggcgagcggacgggagtgccccgtcgccctcttcgaggagcaggccgcccgcaccccggacgccctcgcgctggtcgagggcggcgacggcggactccgtctgacctacgccgagttcgacgcgcgcgccaaccgcatggcgcgcttcctcaccgcccgcgggatcggggccgaggacctggtcggcctggtcttcccgcgcggcgccgacctgctcaccggcctgtggggggcgctcaaggccggtgcggcgtacctgccggtggacgtggactacccggccgagcggatcgggctgctcctctccgacggcgcccccgccctcgtcctgaccacctccgcccacgcccacctggtgcccgaggcgccggggcggcagatcctctgcgtcgacctgcccgggcccgcggacgaactggcccgcgccccggagggaccggtgaccgaccgggagcgtccgcgcccggtcggggccgacaccctcgcctacgtcctctacacctcgggctccaccggccgccccaagggcgtggccatcagccgcggttcgctggccgcgcacgccgtccggtcccgcgaccgctacccggacgccgccggggtgtcgctgctgcactccccggtggcgttcgacctcacggtgacggccctgttcaccacgctcgtctccggcgggaccctgctgctggcggagctcgacgaacacgcccagggcgccggcgtcaccttcgtgaagggcacgccctcccacgtcgcgctcctggacgagctgcccggcgtcctcgacgccaccggggaacgccccggcacgctcgtgctcggcggcgagccgctcaccggcgagatgctggagcgctggcgcgcacgccacccgcaggccagggtcttcaacgactacgggccctcggagaccagcgtgaactgctccgacctggtcttcgagcccggtgacgaggtgccggccggcctgctgccgatcggccggccgctgcccggcaaccacatgttcgtgctcgaccacctgctccagcccgtgccggtcggcgtcgtcggcgagatctacgtctccggtgtcggcgtggcccgcggctaccacggcaggccgggcctgaccgccgagcgcttcctgccctgcccgttcgacgccccgggcgcccggatgtaccgcaccggggacctgggccgctggcggcccgacgggatcatggagtgcctgggccgcaccgacgaccaggtcaaggtgcgcggcttccgggtggagctgggagaggtggaggccgccctcgccgcccgccccgacgtcgcccgcgccaccgtcgtcgtgcgcgaggacgagccgggggacaggaggctgacgggctacgtggtgcccgagggagggccggaggcgggcctcgacaccgccgccgtgctgcgcgacctcgccgcacagctgccggagtacatggtcccggccgcggtcgtggtcctggcggagctgccgcgcaccgagaacggcaagctcgaccgccgggcgctgcccacacccgagtacggcaccaggtccgccgggcgggcgccgcgcaccgccgccgagaccgccctgtgcgccctgttcgcggaggtcctgggagtgcccggggccaccgtggacgacgacttcttcgccctgggcggccactcgctgctggccgtccggctcgcgggccgcatccgggccgagctcggcctgcggctggacatccgcacgatcttcgaccgccgcaccgtcgcggacctcctggccgatccgcagatcgccgcacagctgacggacggcgaggtccccggggcgccggcgcggccggcggagcccgcgccgggcgggcagcccccggccggggagcgaggcggcgccggggccgggcccgagcgcctgcccctgtctcccgcccagcgcagactgtggttcctcaaccgctacgacagggaggccggcggctaccacatcagcgtcgcgctgcgcctgaccggcgacctcgacgtcggcgccctgcacgcggcgctgggcgacctggccgcccggcacgagagcctgcgcacggtcttccgcgaggacgaggaggggccctaccaggtcgtcctgcccgcggcgccgtccccggcgccggccgccgtccccgcctccgcgcgggagctcgacgcgctggtgcgcgaagccgtccgccggcccttcgacctcgccgaggacaccccgctgcggcacaccctgttcgcgctcccggaccgcgagcacgtcctgctcctggtgatccaccacatcgccgccgacggctggtcgatggggccgctggcccgggacctggccgccgcctaccgcgcccgcgcggccggcgacgcgccccggtggccggcgccggcgccgagccacgccgatcacgtgctccggcggcaccgcgcgccggagcacggtggggacgccggcgacccggcggaccaccggctcgcccactgggccgaggagctgcgcggactgcccgacgagctcccgctcccctacgaccggccgcgccccacgacaccccccgggtacgccgagcggatcggcttccggatcgacgccggactgtaccgggacgtgctggccctggcggcccgccaccgggccaccccgttcatggtgctccacgccgccctggccgccctgctgacccggctcggcgccggcaccgacatccccgtgggcaccccctcggcgggccgcgaccggcccgagaccgccgacctcgtcggcttcctggtcaacaccctggtcctgcgcacggacacctcgggcgacccgacgttcggggaactgctggaccgggtgcgcgagaccgacctgagggcgtacacccaccaggacgtgcccttcgaacggctggtggaggcggtcaaccccgcccgctcgcccagcaggcacccgctcgtgcagaccatgctcaccctcgacaacgcggcccagggagcgctggagcacctcctggacctgccgggggtgcgagcggagctgctgccgaccgccgagggcaccgcccacaccgacctcgacctgaccttcgccgagaccggctccgccccgcccgcgggcgggacgggactcgacgggaccctgcagtaccgccccgacctgttcgaccgcgcgaccgcgcaggccctggtggagcggttcgtggcgctgctgcgcacggtgacgcgcgagcccggcctgcggctgggccggctcgacgtcaccaccggcgaggagcgccggcggctggtcgaggaggacgccgccgcccggcgggcgcgggccgagaccaccgtcacggacctgcccgcgctgttcgccgcctgggccgagcggaccccttccgcccccgccctcaccgacggcgggacgaccgtggactacgccgaactggacgcccgctccaaccgcctggcccgcgcactgctggaactcggcgtggggccggaggacttcgtcgccctggccgtgccccgctcggcggacctggtggtggccgtgctcgccgtgctgaagtcgggcgccgcctacctcgcggtggaccccgactacccggccgagcgcacctcctacatcctcggcgactgccggccggccgcggtgctctccacgaccgcggtccgggcggccctgcacggcacggtgggcgaggcggccggcgaggtgccgtggctgctgctcgactcgccccggacccgcgccgcggcggccgggctgtcggcggcgccggtcaccgacgccgaccgccggtcgcccctgctccccgaccaccccgcctacaccatctacacctcgggatcgaccgggcggcccaagggcgtggtcgtcagccacgccaacgtctcgcggctgctggacgtctgccgctcggccgtggacttcgggcgggacgacgtgtggacgctcttccactccagcgccttcgacttctcggtgtgggagatgtggggagccctggcgcacggcggccgactggtggtcgttccgcacgacgtggccagatcccccagggacctcctggagctgctgggccgcgagcgcgtcacggtgctcagccagacgccctcggccttcctccagctcctgcgggccgagaccgagcggggcgtccccgcggaggccaccgccgcgctgaggtacgtcgtcttcggcggcgaggcgctggacaccgcccagctcgccccctggcggggccgcccggtccgcctggtcaacatgtacgggatcaccgagaccaccgtgcacgtcacccacctggagctggacgacgccgccgtggagcgcggcggcagcctcatcggctcccccctggacgacctgcgcgcccacgtgctcgacgaacggctgcgccccgtgccgtcgggcgtcgtcggcgagctgtacgtcgccggccccggcctggcccgcgggtaccggcagcgccccggcctgacggccgcccgcttcgtcgccgacccgtccgacgccggcgggcggatgtaccggaccggcgatctggtcaggcgcgccccggacggcggcctccactacgtcggccggtccgacgcccaggtcaaactgcgcggctaccgcatcgagccgggggaggtcgaggccgccgcacggcgccacccggacatcggccaggcggccgcggtcgtgcacggggacggaccggacgaccggtacctggtctgctacgcggtgccggacggagacgccgaccccgacccgcacgaggtgcgcgcccacctggccggcgccctgcccggctacatggtccccgccgccgtggtgctgctgcccgccctgccgctgacccccaacggcaagctggaccgcagggcgctgcccgccccggaccgggcggcactggccaccggcggcgctccggccggaccgcgcgaggaggcgctctgcgcggccttcgccgacgtcctccgcgtcgaggaggtcagccgggacgccgacttcttcgccctgggcggccactccctgtcggccgtgcggctcatcagccggatccggtcggcgctgggggtggagatcggcatccgcacgctcttcgaggcgcccacgcccgccgcgctggcccggcggctggacaccgccggagccggacggccccgcctggtgccgcagcggcggccgcaccgcgtcccgctctcctccgcccagcggcggctgtggttcctcggggagctggaggggcccggcgcgacgtacaacattccgctcgccctgcggctgcgcggtcccctggacgtcggcgccctgcgcgccgcgctggcggacgtggtggcccggcacgaggcgctgcgcacggtcttcccggccgagaacggagtcccccaccagcacgtggtcgcgcccgaggaggccgcgcccggaccggccgtcgtggacgtcgccgaggaggagctgcccgcggccctcgccgaggcctgcgcatacgcgttcacgctgaccgaggacctcccgctgcgggcggtgctgctgcgcaccggccccaccgaccacgtgctctccctggtcctgcaccacatcgccggcgacggctggtcgctcgccccgctcgcccgcgacctgagcaccgcctacgccgcacgcctggagggccgcgccccgcggtggcggccgctgccggtgcagtacgccgacttcaccctgtggaaggagcggctgctcggcgaggcggacgaccccgacagcctcttcgcacgccagctcgccttctggcgtgacaccctggcgggggcgccggagcagatcgagctgcccaccgaccggccgcgccccgcgatggagagccaccgcggcgcgatccaccgcttcaccctgccggcacggctgcgggaccggctgcgtgcgttggcgcactcccggcaggcgaccttgttcatggccctgcaggcgggcctggcggcgctgttcgccaagttgggggccggccgggacatcgtcctgggcaccccggtcgccggccgcggcgacgaggcggtcgacgacctcgtcggcttcttcgtcaacaccctggcgctccgcaccgacctcggcggcgaccccacgttcgaggagctgctggaccgggtgagggaggcggacctgtccgccttcgcccaccaggacataccgttcgagcagctggtggaggcgctcaaccccacccgctccctctcccggcaccccgtcttccaggtgctgctggccctccagaacaacgaactcggcgaggccgtcatgccgggtctggaggtcaccgtggaacgccccgcccaggtggcggccaagtacgacctcttcgtgaacctggtggagtcccgggacccggccggcggcgcgaccgccatcgagggcgccgtcgagtacgccaccgacctcttcgacgccggaaccgtcgcacggctggccgagcgctaccaggacctgctcctggcggtcaccgaggagcccgcgacgcggctcagccggatcccggtgctgagcggggccgaacgcggcatgctggcggccgagtgggacggcaccgccgcgggcccggccgaggacgtggccgacctcttccgcgcccgcgccaccgcgacgccggaggcggtggcggtccgctgcgccggggagagcctcacgtacgccgagctcggcgagcgggccgaccgggtggcggcggcgctggccgggcggggcgccggccccgaacggcgggtcgcggtgtgcctgccgcgcaccgccgacctggtggcctgcctgctcggagtcctgcgggccggcgccgcctacgtgccgctggacccggagtacccggacgagcgcatcgccgcgatcctgtccgacacccgcccggtggcgctgctcaccacggcggactgccgccccgcgatcaccgctgccgcggccgcctgcggtgccgccaccctcctggcggccgacgccgcacagggcgccgggcccctgcccgaggtgcccgcgccgctgccggaccaggccgcgtacgtgctgcacacctcgggctccacgggacggcccaagggcgtggtcgtcagccggggcaacctcgccaacctgctggccgacatgcgggagcggctgcgcctcaccgccggggaccggctggtggccgtcaccacggtcagcttcgacatcgccgccctggagctgttcctgcccctggtcggcggcgccgaactggtcctggccgaccgcggcaccgcacgggacccggaggcactggcggcactgctcaccgggagcggcgccaccatcctccaggccaccccgaccacctggcagctgctggccgagaccgcgcccgacgccctgcgcgggctgcgcaaactggtgggcggcgaagcgctccccgcgtccctggcctcccgcctgcacggcctgggcggcgaactggtcaacgtctacgggcccaccgagaccaccatctggtccaccgccgcccacctcgaccgggccaccgggagcgcaccgcccatcggccgggcgctgcgcaacacccgcgcctacgtgctggacgagtggctcgacccggtccccgccggcgtccccggcgagctctacctggccggcgccggcgtggcccgcggctacctgggccgcggcgccctgaccgccgagcgcttcaccgccgaccccttcggcgcgcccggcagccgcatgtaccgcacgggcgacctggtccgccggcgcgcggacggggagctggagttcctcggacgcaccgaccaccaggtcaaggtccggggcttccgcatcgagctgggcgagatcgagacggccctcggtgcgcacccggacgtctccggggcggtcgtggtcgcccgcggcgcgtccggcccggcccccgcgccggacgacggcggcaccgccggcccgccccggcagctggtggcctacgtggtcgccgagcccgaccgggccggccacgacgggagccgggagcgggcccggctcgacgagtggcgggagacctacgacaccctctacgacaactccgaaccgacccccctgggccgggacttcgggatctggcggagcagctacgacggacggcccatcccgctggaggagatgctccagtggcgggcggccacggtggaccgcatccgggcgctgcggcccgcgcggctgctggagatcggggtgggcaccggactgctgctgtcggaactggcaccggactgcaccgcctaccacggaaccgacctgtccgcacgggtgatcgagaccctgcacgagcaggtcgcggccgagcccgcgctgaaggagaaggtggagctgcacgtccgcccggcgcacgacttcaccggtctgcgcaggggtttctacgacaccatcgtgctcaactccgtcgtccagtacttccccggcgccgactacctctcccgggtgctgcgcggcgcactcgacctgctggagcccggcggacggctcttcgtcggcgacgtgcgcagcctggcgctgctgcgggccttccgcgcctcggtggagatcggcgacgccgccgcgggcgacgccccgggcccggtgctggcggccgccgaccgcaggacggccacggagaaggaactcgtcgtggacccgggctacttcgcgcggctgcgccgggagaccggcgaacccctcgtcctggacgtgcgggtccggcgggggaggccgctcaacgagctgacgcgctaccgctacgacgtcctgctggccaagccggaggccgggaccgccgctccggccccggccgccgagatgcgctgggcggaggaggtcggagaccgcgcgcggctggccgaggtctgcgcggcacaccgcggcgcgctgcgcgtcaccgcgatccccaacgcccgggtgcggcgcgagacggccgccctcgccgcgctggaggacgggcggccgctcgccgcggcgcggcggctgctggacggccccgccggcggagtggacccggaggacctgtacgacgtggcggcggcggccggccgcaccgcgtgggtgtgctggtcggccgagggaccgccggacaccgtggacctggtgctggccccggcggacgggggcggcgccgcggaggtggcaccgccggccgagctgtggccgtacgagccggacgcggaccggccgcagaccaacgacccgtccgccgcgctgcgcaaccgggaactggccgccgggctgcgcgcgtacctggccggacggctgccggactacatggtgccctcggccgtcgtcgtcctcggcgccctcccgctgaccgccaacgggaaggtggaccgggccgcgctgcccgaccccgacccggcgggcgcggccggcggccggccaccgcgcacgccccgggaggagctgctgtgccggctcttcgccgacctgctgggcctgagccgggtgggcaccgaggacagcttcttcagcctgggcggcgacagcatcctgtccgtccgcctcgtcagccgcgcacgggaacaggggctgccgttgaccacccgcgacgtcttcgagcaccacaccgtggccgcgctggcggcggccctggacggcagggagccggagcagaccgcggccgacggccggccggaccccgccgccggaccgcggcccatcagcgccgaggaactcgccgagctggaggaagagctcggcgcggactgggaggagatgcagtga

SEQ ID NO: 43 - protein, 2135 aa, Streptomyces refuineus
VSGSQRMVEEVLPVTPLQEGLLFHAVFDEDVPDAYVSRLVLALRGDLDAGRLRRAAQALVGRHPALRSAFRQRRSGEWFQLVASRPAVPWEELDLRSAGGPAEADKHLEALLDEHHRTGFDLGRPPLLRFLLARTGEDRHRLAVTYHHIILDGWSMPILMRELVALYGSGGDPSALRPVRPHRDHLDWLARRPSERSAHAWRQALAGLSGPTLVAPGADRNGPLPQQVWTRLTERDTRALTAWARARGVTVNSAVQAAWATVLGRLTGRDDVVFGTTVSGRPPELPGAEDMVGFFINTVPLRVRMRPDEPIGDLVARIQREQTALMEHQHVRLSDIQRWSGQAELFDTSTAFENYPADDLAAVGSSDHAGLRVEGGSGVTTNHFPLSLYALPGPALRLRLDHRPDAVDHDTARRAADLLGRALAAVLGAPATPTAAVAAPRQAPRPRERCAGAAPRGPRTTIVAAFEAQVRAAPGAPAVLAGGRELTYAELDARANRLARLLISRGVGPESRVALTVSRNAWLPVAVLGVLKAGGCYVPVSASLPRERAAFLLRGTAPVCLLTDPDAEAARHAAAGAQDPPGTARSGVERIVLTEELLDRYDPSAPTDAERTAPLLPGHLAYLLHTSGSSGRPKGVAVEHAQVAALLSWAVTGLGADRLRRTVAATSESFDVSVFDTLVPLLVGGRIEIVENTLAVADRAGGEPSLLNAVPSALQALLDRGAPLAVDTFLCAGEPFPASLAAALRAACPRARVGNLYGPTETTVFVTARFLDGTEDGAPPIGRPLPGVRIHVLDPWLRPVPEGVVGELYIAGDHVTRGYWRSPATTAERYVADPFGAPGERMYRSGDLGRRLPGGEIDMVGRADGQVKVRGHRVELGEVESALVSHPDVRQAAATVHDGGPAGPRLVGYVVPGDTVPDTGAVLDHLRLRLPAYMVPSALVVLDELPLTGNGKRDRAALPPPPDRSAATRARAPRGPHETILLALFAEVLGVRPAGIDDDFFALGGHSLLATRLVSRVRTTLGAELGVRDLFEHPTVAALGARIARAGTARPPVSHVRERPGRIPLSFAQRRLWFLHRLQGGSAAYHVPLALRLTGRLDTAALRGAIADVVAGHGSLRTSFHEDAEGPHQVVRDAAEAAELITLVPEPVDDPLRAADEAVAEPFDLTAGLPLRCRLFTRTGTPRAPRDPAEPPAGGEPEEHLLLLVVHHIAADGWSLRIIARDVAAAYAARVDGRRPAPAPPPVDYVDHTLWQHRVLGGPDEEGGPLGEQLAYWRRQLAALPPELALPADRPRPAVSSHRGEDLDFAVPAAAAARMRELAGTTGTTPFMVLQAALAVLLHRMGAGTDIPVGTPVAGRTDGAVEGVVGLFVNTLVLRTDLSGSPTFRQLLDRVRSTALDAYAHQDVPFERLVEVLAPERSLARHPLFQVSLALQNLDDAAAPAGELPGLRAEAVRTRRDGAKFDLSFVLAPGGPEGGDMPGVLTYSTDLFDRATAQGLVDRLLRVLDEVLAAPATPVGKVDVLLPGEAQRALEHGRGPRSGHVADEPLARFEGWAAATPDAPALRWNGGRLTYAELDRRAGAVARVLLGRGIGPEDVVAVAAPRRPEVVAALLGVLKSGAAYLPVDEAWPAERRRQVTADAGARLLLAPGSTDAARAALAPPTGPGTEVLGLADPVFTAAGGSALPAVQTHPRALAYVIYTSGSTGRPKGVGVERGALADYVDGAVRRYPDAAGTALLHSPLTFDLSGTALFTPLAAGGCVVLGEVDREAEESRATFVKATPSHLPLLERHPGLLEEAGTLVLGGEALDGRALRDWRAAHPRATVVNAYGPTELTVNCAEHRIPPGGPVPEGPVPIGRPFAGVRAMVLDAGLAPVPPGVVGELYVAGPGVARGYLGRPGLTAERFLPCPFGEPGERMYRTGDLARRLPGGELEYAGRTDEQVKLRGFRIELAEVAQALAAAESVARAVAVIREDRPGDRRLTGYVVPAAGARPQEDELRSTVARTLPEYMVPSSVVVLDELPTTPHGKLDRRALPAPAHRSRGGRPPRDERERALCRIYAEVLGVPEVGAEDDFFALGGHSLLATRLVNRIRSEFADELDVRAVFEARTVAALAARLRTSRPNARPALRRMSRSENS

SEQ ID NO: 44 - DNA, 6408 bp, Streptomyces refuineus
gtgagcggctcgcagcgcatggtcgaagaggtccttccggtcaccccgctccaggaggggctgctcttccacgcggtcttcgacgaggacgtccccgacgcctacgtcagccggctggtcctcgccctccgcggcgacctggacgccggccggctgagacgggccgcccaggcgctggtgggacggcacccggcgttgcgctcggccttccggcagcggcgctcgggggagtggttccagctggtcgcgtcccgtcccgcggtgccctgggaggagctggacctgcggtccgccgggggcccggccgaggcggacaagcacctggaggcgctcctggacgagcaccaccggaccgggttcgacctcggccggccgcccctgctgcgcttcctgctcgccaggaccggggaggaccgccaccggctggcggtgacctaccaccacatcatcctcgacggctggtcgatgcccatcctgatgagggaactggtcgcgctgtacggcagcgggggcgacccctccgcgctccggccggtccgcccgcaccgcgaccacctcgactggctggcccgacgcccgtccgaacggagcgcccacgcctggcggcaggcgctggcgggactgtccggacccacgctggtggcgccgggcgcggaccgcaacggcccgctgccgcagcaggtgtggacgcggctgaccgaacgggacacccgggcgctcaccgcgtgggcgcgcgcccgcggcgtgacggtgaactcggcggtgcaggccgcctgggcgacggtgctcggccgcctcaccggccgcgacgacgtcgtcttcgggacgaccgtgtcggggcggccgccggagctgcccggtgccgaggacatggtcgggttcttcatcaacacggtgccgctgcgggtgcggatgcggccggacgagccgatcggcgacctcgtcgcccggatccagcgcgagcagaccgccctcatggagcaccagcacgtcagactgtccgacatccagcgctggtcgggacaggccgaactcttcgacacctccacggcgttcgagaactaccccgccgacgacctcgccgccgtcggctcctccgaccacgccggcctgcgcgtggaggggggctccggggtcaccacgaaccacttccccctctccctctacgcactgcccgggccggcgctccgcctgcggctggaccaccggcccgacgcggtggaccacgacaccgcacgacgcgcggcggacctgctgggacgggccctggccgccgtcctgggcgcccccgccaccccgaccgccgcggtcgccgccccgcggcaggcaccgcgaccgcgggagcggtgcgccggcgccgccccgcggggcccccggaccacgatcgtggcggcgttcgaggcgcaggtgcgcgcggcgcccggcgcccccgccgtcctggccggcggccgggagctcacctatgccgagctcgacgcccgcgcgaaccggctggcgcggctgctgatctcccgcggggtcggccccgagagccgggtcgccctcaccgtctcccggaacgcgtggctgcccgtcgccgtcctcggcgtcctcaaggcgggcggctgctacgtccccgtgagcgcctcgctgccgagggagcgcgccgccttcctcctccgcgggaccgcgccggtctgcctgctcaccgaccccgatgcggaggccgcccggcacgccgccgccggagcgcaggacccgccggggaccgcccggagcggcgtcgagcgcatcgtcctgaccgaggagctgctcgaccggtacgacccgagcgcgccgaccgacgccgagcggaccgcgccgctgctgccgggccacctcgcctacctcctgcacacctccggctccagcggccggcccaagggggtggcggtcgaacacgcccaggtggccgcactgctgtcctgggccgtcaccggcctcggcgccgaccggctgcgccgcaccgtggccgccacctcggagagcttcgacgtgtcggtcttcgacaccctcgtcccgctgctcgtgggcggccgcatcgagatcgtggagaacacgctggccgtcgccgaccgggccggcggcgagccctccctgctgaacgccgtcccctcggccctgcaggcgctgctggaccgcggggcgccgctcgccgtcgacaccttcctctgcgccggcgagcccttccccgcctcgctggccgcggccctgcgcgccgcctgcccgcgggcgcgcgtcggcaacctctacggcccgaccgagacgaccgtcttcgtgaccgcccggttcctggacggcaccgaggacggggcaccgcccatcggccggccgctgcccggcgtgcggatccacgtgctcgacccctggctccgcccggtgcccgagggggtggtgggcgagctctacatcgccggggaccacgtcacccgcgggtactggagaagcccggcgacgacggccgagcgctatgtcgccgaccccttcggcgcgccgggcgagcggatgtaccgcagcggcgacctcggacgccggctccccggcggggagatcgacatggtcggccgggccgacggccaggtgaaggtgcgcggccaccgggtcgagctgggggaggtggagtccgcgctcgtctcccacccggacgtccggcaggcggcggccaccgtgcacgacggcggtcccgccggaccgcgcctggtgggctacgtcgtgcccggcgacacggtgcccgacaccggcgcggtcctcgaccacctgcggctgaggctgcccgcgtacatggtgccctcggccctggtggtgctggacgagctgccgctgacggggaacggcaagcgggaccgcgccgcgctgccgcccccgccggaccggagcgccgcgacgcgggcgcgcgctccccgcggcccgcacgaaacgatcctgctcgccctgttcgccgaggtgctcggggtgcgcccggccggcatcgacgacgacttcttcgcgctgggcggccactcgctgctcgccacccgcctggtcagcagggtgcgcaccaccctcggcgccgaactgggggtgcgggacctcttcgagcaccccacggtggcggccctgggcgccaggatcgcccgggccgggacggcccggccgccggtctcgcacgtccgggagcggcccggccgcatcccgctgtcgttcgcccagcggcggctgtggttcctccaccgcctgcagggcggcagcgccgcctaccacgtcccgctcgcactccgcctcaccggccgcctcgacacggccgcgctgcgcggcgcgatcgccgacgtggtggccgggcacgggagcctgcgcacgtcgttccacgaggacgccgagggtccccaccaggtcgtgcgggacgccgcggaggccgccgaactgatcaccctggtcccggagccggtcgacgacccgctccgggcggcggacgaggcggtggccgaacccttcgacctgacggccggcctccccctgcggtgccggctgttcacccggaccggaacgccccgggcaccgcgggacccggcggaaccgcccgccggcggggagccggaggagcatctgctgctcctggtggtgcaccacatcgcggccgacggatggtcgctgcggatcatcgcgcgcgacgtggccgccgcgtacgccgcccgcgtggacggccggcggcccgcgcccgccccgccccccgtcgactacgtcgaccacaccctgtggcagcaccgggtgctcggcggccccgacgaggagggcggcccgctcggcgagcagctcgcctactggcggcggcagctggccgcgctgccgccggaactcgcgctccccgccgaccggccgcgcccggccgtctcctcccaccgcggcgaggacctggacttcgccgttcccgccgcggcggccgcacggatgcgggagctggcggggaccaccggcaccacgcccttcatggtcctccaggccgcgctggcggtcctgctgcaccggatgggcgcgggcacggacatccccgtgggcaccccggtcgccgggcgcacggacggggcggtggagggagtcgtcggactcttcgtcaacaccctcgtgctgcgcacggacctgagcgggtcccccaccttcagacagctcctggaccgcgtgcgcagcaccgccctggacgcctacgcccaccaggacgtgccgttcgagcggctggtggaggtgctcgcccccgagcgctccctggcccgccacccgctcttccaggtctccctcgccctgcagaacctcgacgacgcggcggcaccggcgggcgaactgcccgggctgcgcgccgaagcggtccgcacgcggcgggacggcgccaagttcgacctgtccttcgtgctcgccccgggcggcccggagggcggcgacatgcccggagtgctcacctacagcaccgacctcttcgaccgcgcgaccgcgcaggggctggtggaccggctgctgcgggtgctggacgaggtgctcgccgcccccgccaccccggtggggaaggtggacgtgctcctccccggcgaggcgcagcgggcgctggagcacggccgcggaccccggagcgggcacgtggcggacgaaccgctggcccgcttcgaggggtgggcggcggccacccccgacgcccccgccctgcggtggaacggcggccggctgacctacgccgagctggaccggcgggcgggcgcggtggcccgggtgctcctcgggcggggcatcggacccgaggacgtggtcgcggtggccgccccgcgccgcccggaggtggtggccgcgctgctgggagtgctcaagtccggcgccgcctacctgccggtggacgaggcgtggccggccgagcggcggcggcaggtgacggccgacgccggggcgcgcctgctgctggccccggggagcaccgacgccgcccgcgccgccctcgccccgcccaccgggccgggcacggaggtgctcggcctggcggacccggtcttcaccgccgccggcggctccgccctcccggcggtgcaaacccacccgcgcgcgctcgcctacgtcatctacacctcgggctccaccggccggcccaagggcgtcggcgtggagcgcggggcgctggccgactacgtggacggggccgtccgccgctacccggacgcggcgggcacggccctgctgcactcaccgctgaccttcgacctcagcggcaccgccctgttcaccccgctggccgcgggaggctgcgtcgtgctgggggaggtggaccgggaggcggaggagagccgggcgacgttcgtcaaggcgacaccgtcccacctgccgctgctggagcggcacccggggctgctggaggaggccggcaccctggtgctgggcggtgaggcgctcgacgggcgcgccctgcgcgactggcgcgccgcccacccgcgcgccacggtcgtcaacgcctacggccccacggaactcaccgtcaactgcgccgagcaccgcatcccccccggcggccccgtgcccgaggggccggtgccgatcggccgcccgttcgccggcgtccgcgcgatggtgctggacgcggggctggccccggtgcccccgggcgtggtcggggagctgtacgtcgcggggccgggagtggcccgcggctacctcggccgcccgggcctgaccgcggagcggttcctgccgtgcccgttcggggagccgggggagcggatgtaccgcaccggtgatctggcccgccggctgccgggcggtgaactggagtacgccggccgaacggacgagcaggtgaagctgcgcggcttccggatcgaactcgccgaggtggcgcaggccctggccgcggcggagtcggtcgcccgggcggtcgccgtcatacgggaggaccgccccggggaccggcggctgaccggctacgtggtcccggcggcgggagcccgcccgcaggaggacgaactgcggagcacggtggcccgcacgctgcccgagtacatggtgccctcgtccgtggtggtcctcgacgagctgcccaccacgccgcacggaaagctggaccggcgcgccctgcccgcccccgcgcaccgctcccgcggcggccggccgccgcgcgacgagcgcgaacgggccctgtgccggatctacgccgaagtgctcggcgtacccgaggtcggcgccgaggacgacttcttcgcgctcggcggccactcgctgctcgccacccggctggtcaaccggatcaggtcggaattcgccgacgagctggacgtacgggccgtgttcgaggcccgtacggtcgccgcgctggcagcccggctgcggaccagccgccctaacgcccgccccgcgttgcgacggatgtcgcggtcggagaactcgtga

SEQ ID NO: 45 - protein, 5245 aa, Streptomyces refuineus
VMLPLSLAQQRLWFLHQMDGPSATYNIPTALRMTGALDVAALREALRDVVRRHETLRTVFPDAGDGARQHVLPAAEAAVELTVTGTTEAELPAVLAQEAGHAFDLAREVPLRARLLALGERDHVLCLVIHHIASDGWSRAPLARDLTTAYAARSEGRAPQWEELPVQYADYTLWQRELLGSEEDPESLLSRQTAYWKQALAGLPDAIELPFDRPRPPIAGHRGDTVPITLPPRTHERIAALAGRHGASTFMVVQAALAGLLSRLGAGTDIPLGTSVAGRTDEALEGLIGFFVNTLVLRTDTSGNPTFDELVARARETALDAYAHQDVPFERLVEALAPERSLARHPLFQVSLSLQHATEQTAVLDGLEIAPLDTGWRAAKFDLSFDLLEKHGPGGRPDGITGTVEYSTDVFDAATVRGIGERLVRFLEAAVDAPGARLLSVDLLSAGERRRLLAEFGASRSGTDGTAGAEEEPEPVCDTFARQAAATPEAVAVVGGDTALTFAEADARVSRLARLLISRGAGPETRVAVCLGRNALWPTAVLAVLRSGAAYVPLDPRSPAERLAAVERDATPLIVLAERGTEAAVAGLTAPLLVLDDPRTEAGIEAQDPAPVTDADRTAPLLPGHAAYVIHTSGSTGRPKGVVVDHRGLARLLQAHRRVTFSRIRPHGAGPARAAHVSSFSFDASWDPLLAMVAGHELHMIDEDLRLDPPGVVAYFRDRRIDYVDLTPTYFRSLLDAGLLEETAPCPSLIALGGEAMDGELWERLRAAAPRVTAMNTYGPTETAVDAVVTELGDLPHGTIGRPVPRWRAYVLDAGLQPVPPGVLGELYLAGPGVARGYLGQHGLTAERFVACPFGEPGERMYRTGDLARWLDDGNLVCAGRGDEQVKIRGFRIEPGEVEAALRELEGVAQAAVAVREDTPGTRRLVGYVVGADGADPGLLRPAEVLARLRDRLPDHLVPSALVRIGELPVNASGKLDRAALPAPDPAAFPAGRQPRTDLERDLCALFADVLGTGSVGIDDDFFVRGGDSILSIQLVGSARRAGLEFKVRQVFELRTPAGLATVARRTGAGRQEDPGAAVGPLPPLPVVAETLAAGGPVGEYNQSVVLASPPGAGPDDVRDALQALLDRHDALRIHAAPAAEPGRLWDLRVERAGTVTAERCLRKIDAAGMSEEELAEAVAAEAVAAREALDPVAGALVGAIWFDRGGEPGRLVLVIHHLAVDGVSWRILLGDLREAWRALRDGRRPELPRTGTSLRTWATRLADRAADPAVTAQLDHWTATLADAGPEVGSRPLDRTRDTAATSAVLSGELPEPVTAALLGPAPAAFRAGVNDLLLTAFALAVNHWRGEEGEPVLVDLEGHGRAEDLVPGADLSRTVGWFTSVYPVRLAAGAVTAADLAGRAPAVGDAIKRVKEQLRAVPDEGLGYGLLRHLNPETSRRLAHGARARFGFNYLGRFAAEQGGGEDGWQLLGSGPAGRHPDTPLDHEIEVNAVTAEGPDGPRLITRWTYATGLLTEEEVRRLARSWSLALHAVVGHATGAGAGGLTPSDVAVPDLGQAEIEELERRCGTALEDVLPVAPLQEGLLYHSVYDRRALDVYVGQLAFRLDGEIDEDALRAAAGVLVARHTSLRTGFQQRESGQWVQTVAAAAELPWRSCDLRALEDAPGDAGAAQRRLDELAAAERTERFDLTRPPLVRFLLARTAPEQYRFVITTHHTIVDGWSIPILLRELLALYGGAPLPDAPGHRAYADWLAGRDLRAAREAWTRALEGVGGPTLVAPGAPRVGEIPESVRLNLPEDVSARLRTRAREAGVTLNSVVQAAWALVLAQETGRDDVTFGITVSGRPAELPGAEDMVGMLVNKIPLRVRLRPAEPLLELVRRLEKEQLELLEHQHVPLTALHRWSGLPELFDTTMVFENYPAEITAREAPFRASGTAGYSRNHYPVTLVGAMRGSELTVRIDYRPDLFGEDWARSLGRRVVAALTEAADRPAAPSGTLDLLDGEERARLLEDWGAGGAPQDASRGYVELFEEQVARTPDAPAVTSPGGTLTYAELDRQANGVARWLADRTAGTGGAEVYVGVLAPRRAEALAVLLGVLKSGAAYVPLDEQWPAERTRRVLEDCRPALVVAPAGSRPDGVREAGAEVLAVDPAALASRGAHAPAGDERVRPAAPGGAAYAIYTSGSTGRPKGVVIDHSALGAYVGGARGRYPDAAGTSLAHTSLAFDLTVTTLLTPLAAGGTVRLGELDESAQTAGATLVKATPSHLPMLRELPGVLPDGGTLILGGEALTGKQLRPWLELHPAAQVVNAYGPTELTVNCTEFRLPRGEPVGDGPVPIGRPFPGVRAYVLGPGLRPVPTGTVGELYVSGTGVARGYLGRPGMTAERFVACPFGGPGERMYRTGDLARWRPDGNLEYAGRGDDQVKLRGFRIETAEVARALEGHPAVARAAVVLREDQPGDQRLVGYLVPVAGEGVPDREAVSAAVAAVLPEYMVPSALVVLEDGLPLTANGKLDRAALPVPEFAPVRGVGRAPRGPREEILCGLFAEVLGVPGVGVDDDFFALGGHSLLAIVVISRIRALLDVDLAIDALFEAPTVAGLAAHLDGPQRRPGAVRAVVPRPGRLPLSYAQQRLWFLHQIEGPSATYTVPLALRLTGPLDVAALRAALADVVARHESLRTVFAEDEHGPHQIVLGPRQGAPGLQVVPTTEARLRADLEAEAARPFDLAQAPPVHARLFALDERTHVLLLAVHHIAMDGWSVRPLVRDLAAAYAARRRGAPPALPELPVQYADYTLWQHEELGTEDDPDSAIAAQLRYWRDALRGLPEELALPADRPRPATPSHRGGRVGFTVPPAVHGRVAELAREHRATPFMVVHAALAALLTRLGAGTDVPIGSPVAGRTDDALEDLVGFFVNTLVLRTDTSGDPSFAELLERVRATDLAAYAHQDLPFERLVEVLNPVRSLARHPLFQVLLAFNNGAVPADGPADRASDVLVRPVTVETAAAKFDLSLSFNEDRAADGSAAGIRGVLEYSTDLFDESTAHRTVRYFLRLLGAAVEQPRTPLSGLPVLSEPERHELLVRRNDTARDLPWTSPLRRFEAQAARTPRATALVAGEERICYADLDARADRLAGLLSDGAAGRSGPVAVALRRGALLPVTLLAVWKAGLHYLPLDPGHPRERLADVLADCAPACVVTTADLAGDLPPGPAPLLVLDDPATAERLAAAPGTAPAGAAHAWGHPDDLAYTIYTSGSTGRPKGVMVTRAGVANFLADLTERLELGPDDRLLAVTTVSFDIAVLELFAPLLTGGAVVLADATAQRDPAAVRSLCAREGVTVVQATPGWWHAMAVDGGLDLTGLRVLVGGEALPATLARALLEPGRAPSGDRLLNLYGPTETTVWSTAAHITAGTPEARGGSVPTGTPIANTAAYVLDAALRPVPDGVPGELYLAGTGLARGYLGRPGMTAERFVACPFGGPGERMYRTGDLARWRPDGNLEHLGRTDDQVKVRGFRIELGEVEKALAEAPGVGRAAAAVRPDPAGSARLVGYLVPVAGEGVPDREAVSAAVAAVLPEYMVPSALVVLEDGLPLTANGKLDRAALPVPEFAPVRGAGRAPRGPREEILCGLFAEVLGVPGVGVDDDFFALGGHSLLATRLVARIRSTLGVELGVREVFETPTVAGLAAALSRAGEAGPRLRPADPRPGRLPLSYAQQRLWFVQQLEGPGATYNIPLALRLTGPLDVAALRAALADVVARHASLRTVFAEDEHGPHQIVLAAADGPAPLAGPVRTDEEELPRLLREAADHEFRLDAEPPLRTHLFATAPDEHVLLLVMHHIATDAWSQRPLIADLAAAYAARRAGRAPAWPPLPVEYPDYALWQRARLGDEREAGSELAAQLAYWRDALAGSPEELALPADRPRPAIPSHRGDSVPILVPPAVHGRVAELAREHRATPFMVVHAALAALLTRLGAGTDVPIGSPVAGRTDDALEDLVGFFVNTLVLRTDTSGDPSFAELLERVRATDLAAYAHQDLPFERLVELRDPERSLARHPLFQVALNFDTAETAGARDTAPELDGLTVRRERLGVTTSKFDLTFALTETRTRDGGAGGLRGVLEYSTDLFDRSTARHLVERLGRVLEAVVEAPGTALGEIDVLLPGERELLAGAWSEPDPGPVTTAGAAADGIRFPDLFEAQAARTPHAPAVRDGGREVAYAELNSRANRLARLLAGRGAGPEDTVAVLLPRGAGLITALVAVQKAGAAYVPLDAELPTGRIAHMLDDAKPVLTVTLTGMRDALPAGAGPVVCLDDPATEAALAGLDGADCTDADRRAPAGDRDPAYVVYTSGSTGTPKGVVVEQRSLAAFLVRSAARYRGAAGTVLLHGSPAFDLTVTTLFTPLVAGGCIVVADLDAAEGDAPNRPDLLKVTPSHLAFLDGIASWAAPAADLVVGGEQLTGARLARLRAAHPGMRVYNDYGPTEATVSCADFVLEPGDELPADAVPIGRPLAGHRLFVLDERLRPVPAGVPGELYIAGVGVARGYLGRPGMTAERFVGCPFGGPGERMYRTGDLARWRPDGNLEYLGRGDGQLKVRGFRIEPGEIEAALLDRPEIGQAAVVLRGERLVAYVAAPEAEFDPAALREGLAARLPRYMVPAAIVRLDALPLAPGGKLDHRALPEPPAPADAPHDRRPPRDAWERVLCEAFREVLGVAEVGADDDFFALGGDSIGSIQLVGRVRRAGGRMTVRDVFERRTPAALAARSRQSGAAFEVLGGRATGPVPPTPISSWLAELGGAAEGYNQSVLLRVPAQADEAVLVGALQALLDHHDALRMRAEPAAGHWRMEIGEAGGVDAAAVLERVPAADVPQAELDRLVRAHCAAARERLAPQEGAMLRAVWFDRGPREPGHLALVAHHLVVDGVSWRILTADLGRAWQAVADGREVRLDPVGTPLRVWAQRLAELAADPRRADRCAYWEEQAARPWEAGRLDPAADDRSTEEALSLTLPAGTTRAVLGSVPAALGVGVTEVLLGTFAAAVRRWRPAEAADGVTVDLEGHGREEEVVPGADLSRTVGWFTAAHPVRIPAAGPDDDRAGALRALAGTLDRVPDAGLGYGMLRYLNPRTRERLASLPAPRFGFNYLGRFGDPGADRDGAAEAPAWSPVGSGVAGQPAGLPLAHEIEVNAVAADGPDGPRLIATWSWAGRLHREQDVRELAGLWFRELDELASAERSPAAGPPPPADPAPLVELSDAELDQLEAEWKAD

SEQ ID NO: 46 - DNA, 15738 bp, Streptomyces refuineus
gtgatgcttcccctttccctcgcccagcagagactgtggttcctccaccagatggacggccccagcgccacgtacaacatccccacggcgctgcggatgaccggcgcgctggacgtcgccgcgctgcgcgaggcgctgcgcgacgtcgtgcggcgccacgagacgctccgcacggtcttccccgacgccggcgacggcgcccggcagcacgtcctgcccgcggccgaggccgccgtggagctgaccgtcaccgggaccaccgaggccgaactgccggccgtcctggcccaggaggccggccacgccttcgacctggcccgcgaagtgcccctgagggcgcggctcctcgcgctcggcgaacgggaccacgtgctgtgcctggtgatccaccacatcgccagcgacggctggtcgcgcgccccgctcgcacgcgacctcaccaccgcctacgccgcccgcagcgagggccgcgcgccgcagtgggaggaactccccgtccagtacgccgactacaccctctggcagcgggagctgctcggctccgaggaggaccccgagagcctgctcagccgccagacggcgtactggaagcaggcgctcgccggtctgccggacgccatcgagctgcccttcgaccgcccccgcccgccgatcgccggccaccgcggcgacaccgtgccgatcaccctgccgccgcggacccacgagcggatcgccgcgctggccggccgccacggcgcgagcacgttcatggtggtgcaggcggcgctggccggcctgctgtcccggctcggcgcgggcacggacatccccctgggcacatcggtggccggacgcaccgacgaggcgctggaggggctcatcggcttcttcgtcaacaccctggtgctgcgcaccgacacctccgggaaccccaccttcgacgaactggtcgcaagggcccgcgagaccgccctggacgcctacgcccaccaggacgtgccgttcgagcggctggtggaggcactcgcccccgagcgctccctggcccgccacccgctcttccaggtgagcctgagcctccagcacgccaccgagcagacggcggtcctggacgggctggagatcgccccgctggacacgggctggcgggcggccaagttcgacctgtccttcgacctcctggagaagcacggccccggcggccgtccggacggcatcaccggcaccgtcgagtactccaccgacgtcttcgacgccgccaccgtccgcgggatcggcgagcgcctcgtccgcttcctcgaggccgcggtggacgcccccggggcacgcctgctctccgtcgacctgctctccgccggtgaacggcggcgcctgctggcggagttcggcgcatcgcggtccgggaccgacgggacggccggggccgaggaggagccggaaccggtctgcgacaccttcgcgcggcaggccgccgccaccccggaggccgtggccgtcgtcggcggcgacaccgcgctcacgttcgccgaggccgacgcccgggtctcccggctggcccggctgctgatctcccgcggggccggccccgagacccgggtggccgtctgcctgggccggaacgccctgtggccgacggccgtcctggcggtgctgcggagcggcgccgcctacgtgccgctggacccgcgctccccggccgagcgcctggccgccgtcgaacgcgacgccacccccctgatcgtgctcgccgagcgcggcaccgaggccgcggtcgccggcctcacggccccgctgctggtcctggacgacccgcggaccgaggccgggatcgaggcgcaggacccggccccggtcaccgacgccgaccgcaccgcgcccctcctgcccggccacgcggcgtacgtcatccacacctcgggctccaccggccggcccaagggggtcgtggtggaccaccgcggtctggcgcggctgctccaggcccaccgccgggtcaccttctcccgcattcgcccccacggagcgggacccgcccgggccgcccacgtctcgtccttctccttcgacgcctcgtgggacccgctgctggcgatggtcgccggacacgaactgcacatgatcgacgaggatctgcggctcgacccgccgggagtggtggcctacttccgcgaccgccgcatcgactacgtcgacctcacccccacctacttccgcagtctgctcgacgccggactgctggaggagaccgccccctgcccgtcgctgatcgccctgggcggcgaggcgatggacggcgagctgtgggagcggctgcgcgcggccgccccccgggtgacggcgatgaacacctacggccctaccgagaccgccgtcgacgcggtggtgaccgaactgggggacctgccgcacggcacgatcgggcggcccgtgccgcggtggcgggcctacgtgctcgacgccgggctgcagccggtcccgcccggcgtgctgggcgagctgtacctggccgggcccggggtcgcccgcggctacctggggcagcacggcctgaccgcggagcggttcgtggcctgcccgttcggggagccgggggagcggatgtaccgcaccggcgacctggcgcggtggctcgacgacggcaacctggtctgcgccggacgcggcgacgagcaggtcaagatccgcggcttccgcatcgagcccggcgaggtggaggcggccctgcgggagctggagggcgtcgcgcaggccgccgtggccgtccgcgaggacactcccggaacccgcaggctggtcggttacgtggtgggggccgacggcgccgaccccggcctgctccggcccgccgaggtgctggcgcgcctgcgcgaccggctgcccgaccacctggtgccgtccgcgctcgtacggatcggcgaactgcccgtcaacgccagcggcaagctggaccgggccgcgctgccggcgcccgaccccgcggccttccccgccggccggcaaccgcgcaccgacctggagcgggacctgtgcgcgctgttcgcggacgttctgggcaccgggagtgtcggcatcgacgacgacttcttcgtccggggcggcgacagcatcctctccatccagctggtcggcagcgcccgccgggccggcctggagttcaaggtccggcaggtcttcgagctgcggacccccgcgggcctggccaccgtggcccgccggaccggcgcgggacggcaggaggaccccggcgccgccgtcgggccgctgccgccgctgcccgtggtcgccgagaccctggcggccggcgggccggtcggcgagtacaaccagtcggtcgtcctcgcctccccgccgggcgccgggcccgacgacgtgcgcgacgcgctccaggcgctgctggaccggcacgacgcgctgcggatccacgccgccccggcggcggaacccggccgcctgtgggatttgagggtggagcgggccggcacggtcacggcggagcggtgcctgcgcaagatcgacgcggccgggatgtccgaggaggagctggcggaggcggtggccgccgaggccgtcgcggcccgggaggccctcgaccctgtcgccggagccctcgtcggggcgatctggttcgaccggggcggggagccgggccggctcgtgctggtgatccaccacctcgccgtcgacggcgtctcctggcgcatcctgctcggcgacctccgcgaggcgtggcgggcgctgcgggacggccgccgcccggagctcccccgcacgggcacctcgctgcgcacctgggccacccggctcgccgaccgggccgccgacccggccgtcaccgcccagctggaccactggacggccacgctcgccgacgccggccccgaggtgggcagccgcccgctggaccggacccgggacaccgcggccacctccgccgtcctgagcggcgagctgccggagcccgtcaccgccgcactgctgggcccggccccggcggccttccgcgccggggtgaacgacctgctgctgaccgccttcgcgctggccgtcaaccactggcggggcgaggagggcgagccggtcctggtggacctggagggccacggccgggcggaggacctggtgccgggggccgacctgtcccgtacggtcggctggttcaccagcgtgtacccggtgcggctggccgccggagcggtcaccgccgccgacctcgccgggcgcgccccggccgtcggcgacgcgatcaaacgggtcaaggaacagctgcgggcggtccccgacgaggggctggggtacggcctgctgcgccacctcaaccccgagacgtcccggcgcctcgcgcacggtgcccgggcgcgcttcggcttcaactacctcggccggttcgccgccgagcagggcgggggcgaggacggctggcagctgctcggcagcggcccggcgggccggcacccggacaccccgctcgaccacgagatcgaggtgaacgccgtcacggcggagggcccggacggaccgcggctgatcacccggtggacctacgccaccggcctgctgaccgaggaggaggtgcgccgcctcgcgcgctcctggtcgctggcgctgcacgcggtcgtcggccacgccaccggcgccggcgccggcgggctcaccccctccgacgtggccgtccccgacctcggccaggccgagatcgaggagctggagcggcgctgcggcaccgccctggaggacgtgctgccggtggcccccctccaggagggcctgctctaccacagcgtgtacgaccggcgcgccctggacgtctacgtcggccagctcgccttccgcctggacggcgagatcgacgaggacgccctgcgggcggcggccggggtgctggtcgcccgccacaccagcctgcggacgggcttccagcagcgggagtcgggccagtgggtgcagaccgtggccgccgcggcggagctgccgtggcgctcctgcgacctgcgcgccctggaggatgcgcccggggacgccggggccgcgcagcggcggctcgacgaactggccgcggccgaacgcaccgagaggttcgacctcacccgcccgccgctcgtccgcttcctcctggcccgcaccgcccccgagcagtaccggttcgtgatcaccacccaccacacgatcgtggacggctggtccatccccatcctgctgcgcgagctgctcgcgctctacggcggcgccccgctgccggacgcccccggccaccgcgcctacgccgactggctcgccggccgcgacctccgggcggcccgggaggcgtggacgcgggcactggagggcgtgggcgggccgaccctggtcgcccccggcgccccgcgcgtcggagagatccccgagtcggtgcggctgaacctccccgaggacgtctcggcgcgactgcggacgcgggcccgcgaggccggagtcaccctcaactccgtcgtgcaggccgcctgggcgctcgtcctcgcccaggagaccggccgcgacgacgtcaccttcggcatcaccgtctccggccgccccgcggaactccccggcgccgaggacatggtcggcatgctggtcaacaagatcccgctgcgcgtccggctccgcccggccgaaccgctgctggaactggtccgccggctggagaaggagcagctcgaactgctggagcaccagcacgtcccgctgaccgccctgcaccgctggagcgggctgcccgaactcttcgacaccaccatggtgttcgagaactacccggcggagatcaccgcgcgggaggcgcccttccgcgcgtcgggcacggccggctacagccgcaaccactacccggtcaccctggtcggggcgatgcgcgggagcgagctgaccgtccgcatcgactaccgccccgacctcttcggcgaggactgggcccgctccctgggccggagggtcgtcgccgcgctgaccgaggccgccgaccgccccgccgccccgtccggcacgctggacctgctcgacggcgaggagcgcgcccggctgctggaggactggggcgccggcggcgccccgcaggacgcctcgcgcggctacgtcgagctgttcgaggagcaggtcgcccgcacaccggacgcccccgcggtcacgtcgcccggcggcacgctgacctacgccgagctggaccggcaggcgaacggcgtcgcccggtggctggccgaccgcaccgcgggcaccggcggcgccgaggtctacgtgggcgtgctggccccgcgccgggcggaggcgctcgccgtcctgctcggcgtcctgaagtcgggcgccgcctacgtgccgctggacgagcagtggccggccgaacgcacccgcagggtgctggaggactgccgccccgcactcgtggtggccccggccggcagccggcccgacggcgtgcgggaggccggggcggaggtgctcgccgtggacccggccgccctcgcctcccgcggggcgcacgccccggccggcgacgaacgggtgcgccccgcggcgccgggcggcgccgcgtacgccatctacacctccggttccaccggccgccccaagggcgtggtgatcgaccacagcgccctgggcgcgtacgtcggcggcgcacgcggccgctaccccgacgcggccgggacctcgctggcccacacctcgctcgccttcgacctcaccgtcaccaccctgctcaccccgctcgccgccgggggcaccgtgcggctgggcgagctggacgagtccgcccagaccgccggggccaccctggtcaaggcgacgccctcgcacctgcccatgctgcgcgagctgcccggagtcctgccggacgggggcaccctgatcctcggcggcgaggcactgaccggcaagcagctgcgcccgtggctcgaactgcaccccgccgcgcaggtcgtcaacgcctacgggccgacggaactcacggtcaactgcaccgagttccggctgccgcggggggaaccggtcggcgacggaccggtgcccatcggccgcccgttccccggcgtgcgggcctacgtgctcggccccggcctgcgcccggtccccaccgggaccgtcggcgagctgtacgtgtcgggcacgggggtggcccgcggctacctcggccggccggggatgaccgcggagcggttcgtggcctgtccgttcggggggccgggggagcggatgtaccgcaccggcgacctggcccgctggcggcccgacgggaacctggagtacgccggccgcggcgacgaccaggtcaaactgcgcggtttccgcatcgagacggcggaggtcgcccgcgccctggagggccaccccgcggtcgccagggcagcggtggtgctgcgcgaggaccagccgggcgaccagcgcctggtggggtatctggtgccggtcgcgggggagggggtgccggatcgggaggcggtgtcggccgcggtcgcggcggtgctgcccgagtacatggtgccgtcggcgctggtggtgctggaggacgggttgccgttgacggccaacggcaagctggaccgggccgcgttgccggtgccggagttcgcgccggtgcgcggggtggggcgggcgccgcgcggtccgcgcgaggagatcctgtgcgggttgttcgccgaggtgctgggggtgcccggggtcggggtggacgacgacttcttcgccctgggcggccactccctgctggcgatcgtcgtgatcagccggatcagggccctgctcgacgtggacctggccatcgacgccctcttcgaggcgcccacggtggccgggctggccgcgcacctcgacggcccgcagcgccgccccggcgcggtgcgggcggtggtgccgcggcccgggcggctgccgctctcctacgcccagcagcgcctgtggttcctccaccagatcgaggggccgagcgccacctacaccgtcccgctggcgctgcggctgaccgggcccctggacgtggccgccctgcgcgccgcgctggcggacgtggtcgcccggcacgagagcctgcgcaccgtcttcgccgaggacgagcacggcccgcaccagatcgtcctgggaccgcggcagggcgcgcccggcctgcaggtggtccccaccaccgaggcccgcctgcgggccgacctggaagccgaggccgcccgccccttcgacctcgcacaggcaccgccggtgcacgcccggctcttcgccctcgacgagcgcacccacgtactgctgctggcggtccaccacatcgccatggacggctggtcggtccgccccctggtgcgcgacctggcggccgcctacgccgcccggcgccggggcgcgcccccggccctgcccgaactgcccgtgcagtacgccgactacaccctgtggcagcacgaggagctcggcaccgaggacgacccggacagcgcgatcgccgcgcaactgcggtactggcgggacgccctgcgcggactgccggaggaactggcgctccccgccgaccgccctcgccccgccaccccctcccaccgcgggggccgggtcggcttcaccgtcccgccggcggtgcacgggcgggtggccgagctggcccgggagcaccgggcgacgcccttcatggtggtgcacgcggcgctggcggcgctgctgacgcggttgggggcggggacggacgtgccgatcggctcgccggtggccgggcgcaccgacgacgcgctggaggacctggtggggttcttcgtgaacacgctggtgctgcgcaccgacacctcgggcgacccgagcttcgcggagctgctggagcgggtgcgcgccaccgacctggcggcctacgcccaccaggacctccccttcgaacggctggtggaggtgctcaacccggtgcgctcgctcgcccgccacccgctcttccaggtgctgctggccttcaacaacggcgcggtgcccgccgacggacccgccgaccgggcctcggacgtcctggtccggcccgtgacggtggagaccgcggcggccaagttcgacctgtcgctgtccttcaacgaggaccgggcggccgacggctcggcggcggggatccggggcgtactggagtacagcaccgacctgttcgacgagagcacggcccacaggacggtccggtacttcctccggctgctgggcgcggcggtcgagcagccccgcacaccgctgagcggccttcccgtcctgagcgagccggagcggcacgagctgctcgtccggcgcaacgacaccgcccgcgacctgccctggacctcgccgctgcggcgcttcgaggcccaggccgcccggaccccccgggccacggccctggtcgccggcgaggagcggatctgctacgccgacctcgacgcacgggccgaccggctcgccgggctgctgtcggacggcgccgcgggacggagcggaccggtcgcggtcgcgctgcggcgcggcgccctgctgccggtgacgctgctcgccgtctggaaggcgggactgcactacctgcccctggaccccggccacccgagggagcggctggcggacgtcctcgccgactgcgcgcccgcatgcgtggtcaccaccgcggacctcgccggcgacctccctcccggcccggccccgctgctcgtcctggacgacccggccaccgccgaacgcctggccgccgcgcccggcaccgcaccggccggggccgcgcacgcctggggccacccggacgacctggcgtacaccatctacacctccggctccaccggccgccccaagggcgtcatggtgacccgggcgggcgtggcgaacttcctcgccgacctgaccgagcggctggagctggggcccgacgaccggctgctggcggtcacgacggtctccttcgacatcgccgtcctggagctcttcgcccccctgctcaccggcggcgcggtcgtcctggccgacgccaccgcccagcgcgaccccgcggccgtgcggtccctgtgcgcccgcgagggcgtgacggtcgtccaggccacccccggctggtggcacgccatggccgtggacggcggcctggacctcaccggcctgcgcgtgctggtgggcggcgaggcgctgccggcgaccctggcccgcgccctcctggagcccggccgcgcgccgtccggcgaccgcctgctcaacctgtacgggccgacggagaccaccgtctggtccaccgccgcgcacatcaccgccgggaccccggaggcgcgcggcggctcggtgcccacggggacgccgatcgccaacaccgccgcctacgtgctggacgccgcgctccggcccgtgccggacggagtgccgggcgaactctacctggccgggaccgggctggcccgcggctacctcggccggccggggatgaccgcggagcggttcgtggcctgtccgttcggggggccgggggagcggatgtaccgcaccggcgacctggcccgctggcggcccgacgggaacctggagcacctcggccggaccgacgaccaggtcaaggtccgcgggttcaggatcgagctgggcgaggtcgagaaggccctggcggaggcccccggcgtcggccgggccgccgcggccgtgcgcccggatcccgccggctccgcccgcctggtggggtatctggtgccggtcgcgggggagggggtgccggatcgggaggcggtgtcggccgcggtcgcggcggtgctgcccgagtacatggtgccgtcggcactggtggtgctggaggacgggttgccgttgacggccaacggcaagctggaccgggccgcgttgccggtgccggagttcgcgccggtgcgcggggcggggcgggcgccgcgcggtccgcgcgaggagatcctgtgcgggttgttcgccgaggtgctgggggtgcccggggtcggggtggacgacgacttcttcgccctgggcggccactccctgctggccacccggctggtcgcgcggatccgcagcacgctcggcgtcgagctgggggtccgggaggtcttcgagacgccgacggtggccgggctggccgccgcactgtcccgggcgggggaggccgggccccggctgcgccccgccgacccgcgacccgggcggctgccgctctcctacgcccagcagcgcctgtggttcgtgcagcaactggagggaccgggcgccacctacaacatcccgctggcgctgcggctgaccgggcccctggacgtggccgccctgcgcgccgcactggcggacgtggtcgcccggcacgcgagcctgcgcaccgtcttcgccgaggacgagcacggcccgcaccagatcgtcctggccgccgccgacggccccgccccgctcgccggcccggtccgcaccgacgaggaggaactcccccgcctcctgcgggaggcggccgaccacgagttccggctggacgccgaaccgccgctgcgcacacacctgttcgccacggcacccgacgagcacgtgctgctgctggtcatgcaccacatcgccaccgacgcctggtcgcagcggccgctgatcgccgacctggcggccgcctacgccgcccgccgcgcgggccgggccccggcctggccgccgctgccggtcgagtaccccgactacgccctgtggcagcgggcccgcctgggggacgagcgggaggccggcagcgagctggccgcccagctggcctactggcgggacgccctggcgggctcccccgaggagctggcgctccccgccgaccggccccgtcccgccatcccctcccaccgcggggacagcgtgccgatcctggtcccgccggcggtgcacgggcgggtggccgagctggcccgggagcaccgggcgacgcccttcatggtggtgcacgcggcgctggcggcgctgctgacgcggctgggggcggggacggacgtgccgatcggctcgccggtggccgggcgcaccgacgacgcgctggaggacctggtggggttcttcgtgaacacgctggtgctgcgcaccgacacctcgggcgacccgagcttcgcggagctgctggagcgggtgcgcgccaccgacctggcggcctacgcccaccaggacctccccttcgaacggctggtggaactccgcgaccccgagcgctcgctcgcccgccacccgctcttccaggtggcgctgaacttcgacacggccgagacggccggcgcgcgcgacaccgcacccgaactggacgggctgaccgtgcgcagggaacggctcggcgtcacgacgtcgaagttcgacctcaccttcgcgctcaccgagacccgcacccgcgacggcggcgccggcggactgcgcggcgtgctggagtacagcaccgacctgttcgaccgcagcaccgcccggcacctggtggagcggctcggccgggtgctggaggccgtcgtggaggcgcccggcaccgctctcggcgagatcgacgtcctgctgccgggcgagcgcgaactcctggcgggcgcgtggagcgaacccgaccccgggccggtcaccaccgccggggccgccgcggacggcatccgcttcccggacctgttcgaggcgcaggccgcccgcaccccgcacgcgccggcggtccgcgacggcggccgggaggtcgcctacgccgagctgaacagccgggccaaccggctggcccggctgctcgccgggaggggagccggccccgaggacaccgtcgcggtcctgctgccgcgcggcgccgggctgatcaccgcactggtggcggtccagaaggccggagccgcctacgtccccctggacgccgagctgcccaccggtcggatcgcccacatgctggacgacgccaagccggtgctcaccgtgaccctcaccgggatgcgggacgcgctcccggccggggcgggccccgtggtctgcctggacgacccggccaccgaggccgcgctcgccgggctcgacggcgccgactgcaccgacgccgaccgccgcgcgccggccggggaccgcgatccggcctacgtcgtctacacctcggggtccaccggcacaccgaagggcgtcgtcgtcgagcagcggtccctcgccgccttcctggtgcgctcggccgcccggtaccgcggcgccgcgggaaccgtgctgctgcacggctccccggccttcgacctcacggtgaccacgctgttcaccccgctggtcgccggcggctgcatcgtggtggcggacctggacgcggcggagggcgacgccccgaaccggcctgacctgctgaaggtcacgccgtcccacctcgccttcctggacgggatcgcctcctgggcggcccctgccgccgacctggtcgtcgggggcgagcaactgaccggagcccggctggcccggctgcgcgcggcgcaccccgggatgcgcgtctacaacgactatgggcccaccgaggcgaccgtcagctgcgcggacttcgtactggagccgggcgacgaactgcccgcggacgccgtgccgatcgggcgccccctggcggggcaccggctgttcgtcctggacgagcgcctgcgcccggtgccggccggcgtccccggcgagctgtacatcgccggcgtgggggtggcccgcggctacctcggccggccggggatgaccgcggagcggttcgtgggctgcccgttcggggggccgggggagcggatgtaccgcaccggcgacctggcccgctggcggcccgacgggaacctggagtacctcggccgaggcgacggccagctgaaggtccgcggcttccgcatcgaaccgggggagatcgaggcggcgctgctcgaccgcccggagatcggccaggccgccgtcgtcctgcgcggggaacgcctggtcgcctacgtcgcggccccggaggcggagttcgacccggccgcgctccgggagggactcgccgcccggctgccgcggtacatggtcccggccgcgatcgtccggctggacgccctgccgctggcccccggcgggaagctcgaccacagggcgctgccggagcctccggcgcccgcggacgccccgcacgaccgcaggccgccgcgggacgcgtgggagcgcgtgctgtgcgaggcgttccgggaggtgctcggggtcgcggaggtcggggccgacgacgacttcttcgcgctcggcggcgacagcatcggctccatccagctcgtcggccgggtccgcagggcgggtggccggatgaccgtccgcgacgtcttcgaacggcggacgcccgccgcgctcgcggcccgctcccggcagagcggggcggccttcgaggtgctcggcggccgggccaccggcccggtgccgcccacgccgatcagctcctggctggccgaactcggcggcgcggccgagggctacaaccagtccgtgctgctgcgcgtcccggcccaggcggacgaggccgtcctcgtcggcgccctccaggcgctgctggaccaccacgacgcgctgcggatgcgggccgagccggcggccggccactggcggatggagatcggcgaggcgggcggcgtggacgcggccgcggtgctggagcgggtgccggcggcggacgtcccgcaggcggagctggaccggctggtccgcgcgcactgcgccgcggcccgcgaacggctcgccccgcaggagggcgccatgctgcgcgccgtctggttcgaccgggggccgcgggagccgggccacctcgcgctcgtcgcccaccacctggtcgtggacggggtgtcctggcgcatcctcaccgccgacctcggccgggcgtggcaggcggtcgccgacggccgggaggtccggctcgacccggtgggcaccccgctgcgggtctgggcgcagcggctggcggagctcgccgccgacccgcgccgcgccgaccggtgcgcctactgggaggagcaggcggcacggccctgggaggccggtcgcctcgacccggccgcggacgacaggagcaccgaggaggccctgtccctgaccctcccggccggcaccacccgggccgtgctgggctcggtgcccgccgcactgggggtgggggtgaccgaggtcctgctgggaacgttcgccgccgccgtgcggcggtggcgcccggcggaggccgcggacggcgtcacggtggacctggagggccacggccgcgaggaggaggtggtccccggggccgatctctcccgcacggtcggctggttcaccgccgcccacccggtccggatcccggccgccgggccggacgacgaccgggccggcgcgctgcgggcgctggccgggacgctggaccgggtgccggacgccggcctgggctacggcatgctgcggtacctcaacccgcggacccgggaacggctcgcctccctccccgcgccgcgcttcggcttcaactacctgggccggttcggcgacccgggcgcggaccgggacggggccgcggaggcccccgcctggtcgccggtgggcagcggggtcgcgggccagcccgcggggctcccgctcgcccacgagatcgaggtcaacgcggtcgccgccgacggccccgacggcccccgcctgatcgccacctggtcctgggccggccggctccaccgggagcaggacgtccgggagctggccgggctgtggttccgggaactggacgagctcgcctccgccgaacggtccccggccgccggccccccgcccccggcggacccagcccccctggtcgagctctccgacgccgaactcgaccagctcgaagcagagtggaaggccgactga

SEQ ID NO: 47 - protein, 2394 aa, Streptomyces refuineus
MRRSLQDVLPLSPLQEGLLFHSEYAGDEAVDVYTVQTEVELHGPLDVPALRAAAEALLRRHDNLRAGFATRALKDPVQFVPREVELPWEEADLRAAGDPEAEAARRLDEHRWRRFRPAKPPLVRFLLLRTAQDRHRFALTNHHILLDGWSMPVLLRELMLLYRTGGDASALPPVRRYRDYLAWLDRRDERAAQDAWRRALEGLEAPILVAPRADRAAEAPQWLDFELPAAASAGLTRAARGAGLTLNTVVQGLWALTLARTTGSQDVVYGVVVSGRPPELDGVESMVGLFANTVPLRARMPAAEPLTDFLRRLQREQSALLDHQHVRLADIQRLVGQGELFDSVMAFENYPAGPAEEPPGDSPAAPGRVRAVASRMRDAMHYPLGLLASPGPPVRFRLGHRPSAVTPRLAAALRDRLLRLVDAFLAAPDLPLGRLDVLDDAERALVLEKFNDTAREVEDTTATELFLRQAARTPGRTAVETADRSIGYGRLADRSGRLARLLVERGARAERFVALALPRSPELVEAALAVWQTGAAYVPVDPGHPADRVARLLREAEPLLTVTTADLAGRLPADLPLLVLDAPRTVAALEELPGGPLGDGERPSPPDPGNAAYAIYTSGSTGRPKGVVATHRSLVGYLLRGSQEYPSDGRSLVHSPVSFDLTVGALYVPLVSGGTVRLASLDDEPVLRPGEAPPDFAKVTPSHLPVLEGLPREVSPTAAITFGGEQLTGRHLRRWRADHPDVTVYNVYGPTETTVNCSEHRIAPRAPVADGPVPIGRPLWNTRLFVLGPGLVPVPVGVPGELYVAGSGLARGYLRDPGRTAERFVACPYAAGERMYRTGDLVRWNEDGLLEYLGRADDQISLRGFRVEPGEVEAALAAHPAVRRAAVVMREDAAGDARLVGYVVPAGEDAGDGAPPSAPAGSDTGLPTAQITEHLRRMLPPYMVPSHLVELPALPVTPNGKIDRAALPEPPAAGDSAGGAPRSPREEILCGLFADVLRRPQVSIDDDFFALGGHSLLATRLASRVRAALDVELPVRRLFEHPTVRSLSALLDSRGGERPPVRPAERPERVPLSYAQQRLWILHRLTGPDATYNIHRALRLDGDLDVRALEAALHDVAERHETLRTVIAEGAEGPFQKVLPARRTDERLTVLPAAEEEVDRTVGELAAHRFDLEAEPPMRAWLLETGPHSRVLVLVLHHIASDGWSGRRLLRDLFTAYTARRAGRAPNWRPLPVQYVDYALWQRRFLGDPADPGSTAAAQLEYWERQLAGLPEELRLPADRPRPAVPSRTGGQVWLTLPASVHTAVVDLARTCRASVFMVVQAAVAAFLTRMGAGEDIPVGTPVAGRTDEAVEDLVGFFVNTLVLRTDTSGDPAFAELVGRVRETALAAYAHQDLPFEQLVERLSPARSLGRHPLFQVALSCNNTEEQLGRQGSPPPGLAVSPHQVETARSKFDLMFTFLEGHGEDGRPAGIETALEYSADLFDRETAQDLLEAFGRMLALWAADPGGPIGARELLAADERHTVVAEWNATRRAGLVATLPEMFQEQVARTPDAPAVEHAGRGLTYAELNARANRLARVLVRHGVGPERRVALLMPRSLGQVTALLAVLKAGGAYVPVDPGHPEERIAFMLRDSAPALVLAAESCAAGRGEIAGVPVLVPDDGPAGAEPDGPSAADLTDGDRNAPLTAGNAAYVVYTSGSTGRPKGVVTEHRGLLSLAVAQRERYPVRAGSRVLQLASPSFDGAVLELLMAFATGGTLVLADRPLLAGELLGETIAARRISHAFIPPAALTGLTPEGLDCLRCLVVGGEAVTASVVDRWAPGRRMLNVYGPTEATAVTLTSGALSPGGPAPAIGTPVPNTRAYVLDDRLRPVPPGVTGELYLAGASLARGYGDRPGLTATRYVGCPFGEPGERMYRTGDLARWDREGRVHYVGRADEQIKLRGFRVEPGEVQARLTEHAAVREAAVVLREDEPGERRLVAYAVPADGLPRPTAAELRAHLAALLPPYMVPSAYLVLDALPANANGKLDRDALPEPEPLAEEGGRPPSDEREAALCEVFAEVLGREWIGADDGFFENGGHSLLATRLVTRVRERLGVPVAARDLFEAPTAAGLAERIGRGAERRAPAPLLTLRGRGDQPPLFCVHPAVGLGWAYAGLLQRLPADVPLYALQARTPAAGGGLPRSIEEMAGDYVRLVRAVRPHGPYRLLGWSLGAHVAHTMAGLLERDGERVDLLAVLDAYPPHRTGTTGREGTEAEIVAANLRESGFAWEEAELRDGRFPLERFRAHLRRMDSSLGHLDDGELTAAKDVYVNNVRLMRSHTPGRVRCGIVLMTAERSRSLDPGAWDAHTEEGVEVHRVDAAHMSMLTEPTSVAEVGRVLTRRLDSLRGADTKKREV

SEQ ID NO: 48 - DNA, 7185 bp, Streptomyces refuineus
atgcgccgatccctacaggacgtcctgcccctttccccgctgcaggagggcctgctcttccacagcgagtacgccggcgacgaggccgtcgacgtctacaccgtccagaccgaggtggaactgcacgggccgctggacgtgccggcgctgcgcgcggccgccgaggcgctgctgcggcgccacgacaacctgcgggcgggttttgcgacccgcgccctgaaggaccccgtgcagttcgtccccagggaggtcgagctcccctgggaggaggccgacctgcgcgcggccggcgatccggaggcggaggcggcacggcggctggacgagcaccgctggcgccgcttccggcccgccaagccgccgctggtgcggttcctgctgctgcgcacggcgcaggaccgccatcggttcgccctcaccaaccaccacatcctgctcgacggctggtcgatgccggtgctgctgcgcgagctcatgctgctctaccgcaccggcggcgacgcctccgccctgccgccggtgcgccgctaccgcgactacctggcctggctggaccgccgcgacgagcgggcggcgcaggacgcctggcggcgcgcgctggagggtctggaggcccccatcctcgtcgccccgcgggccgaccgggcggcggaggcgccgcagtggctggacttcgaactgcccgcggcggcctcggccggactgacccgggccgcccgcggcgccggcctcacgctcaacaccgtcgtgcaggggctgtgggccctgaccctcgcccgcaccaccggcagccaggacgtggtgtacggcgtggtcgtctccggccggccaccggaactggacggcgtcgagtccatggtcggcctgttcgccaacaccgtcccgctgcgggcccggatgcccgcggccgaaccgctgacggacttcctccggcggttgcagcgcgagcagagcgcgctcctggaccaccagcacgtgcggctggccgacatccagcgcctggtcggccagggcgagctgttcgactcggtgatggcgttcgagaactacccggccgggcccgcggaggagccccccggcgattcccccgccgcgccggggcgggtgcgcgcggtggcgtcgaggatgcgcgacgccatgcactacccgctcggcctgctcgcctcccccggcccgccggtgcggttccgcctgggccaccggcccagcgcggtgacgccgcgtctggcggctgccctgcgcgaccgcctgctgcggctcgtcgacgccttcctggctgccccggacctgcccctggggcggctcgacgtcctcgacgacgccgaacgggccctggtgctggagaagttcaacgacaccgcgcgcgaggtcgaggacaccaccgccaccgagctgttcctccggcaggccgcccgcacccccgggcggaccgccgtggagacggccgaccgcagcatcggctacggccggctcgccgaccgctccggccggctggcccgcctgctggtggagcgcggggcgcgggccgagcggttcgtcgccctggcgctgccgcgctcgccggaactggtcgaggccgcgctcgcggtgtggcagaccggcgccgcctacgtaccggtcgaccccggccacccggccgaccgggtggcccggctgctgcgggaggccgaaccgctcctcaccgtcaccaccgccgacctggccggccggctgccggcggacctcccgctgctggtcctggacgctccgcggaccgtcgccgcgctggaggaactgcccggcggcccgctgggcgacggcgagcgcccctcgccgccggacccggggaacgccgcctacgccatctacacctccggctccaccggacggcccaagggcgtggtggccacccaccggtccctcgtcggctacctgctgcgcggctcgcaggagtacccgtccgacggacgctccctggtgcactcgccggtctccttcgacctcacggtcggcgccctctacgtcccgctggtcagcgggggcacggtccgcctcgcctccctggacgacgagccggtcctgcgccccggcgaggcacccccggacttcgcgaaggtgacccccagccacctgccggtcctcgaagggctgccgcgggaggtcagcccgaccgcggcgatcaccttcggcggcgaacagctcaccggccggcacctgcggcggtggcgcgccgaccacccggacgtcaccgtctacaacgtctacgggcccaccgagacgaccgtgaactgctccgagcaccggatcgccccgcgcgccccggtcgccgacggcccggtgcccatcgggcggccgctgtggaacacccgcctgttcgtcctcggccccggcctggtcccggtgccggtcggcgtccccggcgagctgtacgtcgccgggtccggcctggcccgcggctacctccgcgacccgggcaggaccgccgagcgcttcgtggcgtgcccctacgccgccggggagcggatgtaccgcaccggcgacctcgtccggtggaacgaggacggcctgctggagtacctcggcagggcggacgaccagatcagcctgcggggcttccgggtggagcccggcgaggtggaggcggcgctggcggcccaccccgccgtgcgccgggccgcggtggtgatgcgggaggacgcggcgggggacgcccggctggtcggctacgtcgttcccgccggggaggacgccggggacggcgcgcccccctccgccccggccggatccgacaccgggctgcccaccgcgcagatcaccgagcacctgcgccggatgctgccgccctacatggttccctcgcacctggtcgaactgcccgcgctgcccgtcacgcccaacggcaagatcgaccgcgccgcgctgccggagccccccgccgcgggcgactccgccgggggagcgcccagatccccccgcgaggagatcctgtgcgggctcttcgccgacgtgctccggcgcccgcaggtctccatcgacgacgacttcttcgccctgggcggccactccctgctggccacccgcctggccagcagggtgcgggcggccctggacgtggagctgccggtgcgccggctcttcgagcaccccacggtgaggtccctgtccgcgctgctggactcccgcggcggcgaacgcccgccggtgaggccggcggagcgcccggagcgcgtcccgctctcgtacgcccagcagcggctgtggatcctgcaccggctcaccggccccgacgccacctacaacatccaccgggccctgcggctcgacggcgacctcgacgtccgggcgctggaggccgcgctgcacgacgtggccgaacggcacgagacgctgcgcaccgtcatcgccgagggcgccgagggcccgttccagaaggtgctgccggcccggcggacggacgagcgcctcaccgtcctgccggcggccgaggaggaggtggaccgcaccgtcggcgagctggcggcccaccgcttcgacctggaagccgaaccccccatgcgggcctggctgctggagaccggcccgcacagccgggtgctcgtgctggtgctgcaccacatcgccagcgacggctggtcgggcaggaggctcctgcgcgacctgttcaccgcctacaccgcacgccgcgcgggccgggccccgaactggcggccgctgccggtgcagtacgtggactacgccctgtggcagcggcggttcctcggcgatcccgcggaccccggcagcaccgcagccgcccagctggagtactgggagcggcagctggccggtctgccggaggagctgaggctgccggccgaccggccgcgtccggccgtcccgtcccgcaccggcggccaggtctggctgacgctgcccgcatccgtccacaccgccgtggtcgacctggcccggacgtgccgggcgagcgtgttcatggtcgtccaggccgccgtcgcagccttcctcacccggatgggcgccggggaggacatccccgtcggcaccccggtggccgggcgcaccgacgaggcggtggaggacctggtcggattcttcgtcaacaccctggtcctgcggaccgacacctccggcgaccccgcgttcgccgagctggtcggacgggtccgcgagaccgcgctggccgcctacgcgcaccaggacctgcccttcgagcagctggtggagcgcctgagcccggcccgctcgctcggccggcacccgctcttccaggtcgccctctcctgcaacaacaccgaggagcagctggggcgccagggctccccgccccccggactcgccgtcagcccccaccaggtggagaccgcgcggtcgaagttcgacctgatgttcaccttcctggagggccacggggaggacgggcggccggccgggatcgagaccgccctggagtacagcgccgacctcttcgacagggagaccgcgcaggacctgctggaggcgttcggccggatgctggcgctctgggcggcggacccgggcggccccatcggagcccgggagctgctcgcggccgacgagcggcacacggtcgtggccgagtggaacgccacccggcgcgcgggcctggtcgcgacgctgccggagatgttccaggagcaggtcgcccggactcccgacgcccccgccgtggagcacgccggccgcgggctgacgtacgccgaactcaacgcccgggccaaccggctcgccagggtgctggtccggcacggcgtcggccccgagcgccgggtggccctgctgatgccccgctccctcgggcaggtcaccgcgctgctggcggtgctcaaggccggcggcgcctacgtgccggtggaccccggccacccggaggagcgcatcgccttcatgctgcgcgacagcgcccccgcgctggtcctggcggccgagtcgtgcgcggcgggacgcggggagatcgccggggtcccggtcctggtgcccgacgacgggccggccggggcggagccggacgggccgtccgccgccgacctcaccgacggggaccggaacgcccccctgaccgccggcaacgccgcgtacgtcgtctacacctccggctccacgggccgccccaagggcgtggtgaccgagcaccgcggtctgctgtcgctggccgtggcgcagcgggagcggtacccggtgcgggccggcagccgtgtgctgcagctcgcgtcgccgtccttcgacggcgccgtgctggagctgctgatggcgttcgccaccggagggacgctggtcctggccgaccggccgctcctggccggggagctgctcggcgagaccatcgccgcgcggcggatcagccacgccttcattcccccggcggcgctgaccggtctcacgcccgagggactggactgcctgcgctgcctcgtcgtcggcggcgaggcggtcacggcctcggtcgtggaccgctgggcgcccggccggcgcatgctcaacgtctacggcccgaccgaggccaccgcggtcaccctgaccagcggagccctctccccgggcggaccggcgcccgccatcggcacgcccgtgcccaacacccgggcctacgtgctcgacgaccggctgcggccggtgccccccggggtgacgggcgagctctacctggccggcgcgtcgctggcgcgcggctacggcgaccgccccgggctcaccgcgacccggtacgtcggctgcccgttcggggagccgggggagcggatgtaccgcaccggcgacctggcgcgctgggaccgggaggggcgagtccactacgtgggccgcgcggacgagcagatcaagctgcgcggtttccgggtggagcccggcgaggtccaggcccggctcaccgagcacgccgcggtgcgggaggcggccgtcgtcctgcgggaggacgagccgggggagcgcagactggtggcctacgcggtgccggccgacggcctgccccggcccaccgccgcggaactgcgggcccatctggccgccctcctgccgccctacatggtgccctcggcctatctggtgctggacgccctcccggccaacgccaacggcaagctcgaccgggacgccctgcccgaaccggaaccgctcgccgaggagggcggccggccgccgagcgacgaacgggaggccgccctgtgcgaggtgttcgccgaggtgctggggcgcgagtggatcggtgccgacgacgggttcttcgagaacggggggcactcgctgctggccacccggctggtcacgcgggtccgcgagcgcctcggggtgcccgtcgccgcgcgggacctgttcgaggcgccgacggcggccggcctggccgagcgcatcgggcggggcgccgagcgccgcgccccggcgcccctgctgacgctgcgggggcgcggcgaccagccgccgctgttctgcgtccacccggccgtcggcctggggtgggcgtacgcgggcctcctccagcggctccccgcggacgtcccgctctacgcgctgcaggcccgcacacccgccgccggcggcggactgccgcgcagcatcgaggagatggccggcgactacgtccggctggtccgcgccgtccggccgcacgggccgtaccggctgctcggctggtcgctgggggcccacgtggcccacaccatggccggcctgctggagcgcgacggcgagcgggtggacctgctcgccgtgctggacgcctaccctccccaccgcacggggacgaccggacgggaggggacggaggccgagatcgtcgcggccaacctgcgggagtcgggattcgcctgggaggaggcggagctgcgcgacggacgcttcccgctggagcggttccgtgcccacctgcgccggatggacagctcgctcggccacctcgacgacggcgagttgacggcggccaaggacgtctacgtcaacaacgtacggctcatgcggtcccacacccccggacgcgtccgctgcgggatcgtgctgatgaccgcggagcgctcccgcagcctcgaccccggggcgtgggacgcgcacaccgaggagggcgtcgaggtgcaccgcgtcgacgccgcccacatgtccatgctcaccgaaccgacgtcggtcgccgaagtcggccgcgtcctgacccgccgactggactccctgcggggagccgacacgaagaaacgagaggtgtga

SEQ ID NO: 49 - protein, 78 aa, Streptomyces refuineus
MTNPFDDAEGTFHVLVNDEGQHSLWPNFVEVPAGWRAVVEDRPRQECLDYIEENWTDMRPKSLIEAMEAHEKAATAAE

SEQ ID NO: 50 - DNA, 237 bp, Streptomyces refuineus
atgaccaaccccttcgacgacgccgagggcaccttccacgtcctggtcaacgacgagggccagcactcgctgtggccgaacttcgtggaggtcccggcgggctggcgggcggtggtggaggaccgcccccgccaggagtgcctggactacatcgaggagaactggaccgacatgcgccccaagagcctcatcgaggccatggaggcccacgagaaggccgcgaccgcggccgagtga

SEQ ID NO: 51 - protein, 271 aa, Streptomyces refuineus
MPTTRINGIALDHDRTGSGPPVLLIMGSGAAKSAWHLHQVPALVAEGFEAVTFTNRGVPPSGGGPGFTLGDMAADTVGLIEHLGIGPCAVVGMSLGARVAREVARTRPDLVSRCVLVAPRARSDRMRAACTAAEIALADSGVTLPPRYRAVVRAMQNLSPRTLADDRQIADWLDVLELAAADGPGLRTQLELSAADDRGEDLAGITAPCRVIAFADDIVAPPHLAKEIADALPEADYHVVPDCGHYGYLERPDRVNRLITEFLRAPQTTQG

SEQ ID NO: 52 - DNA, 816 bp, Streptomyces refuineus
atgccgaccacacggatcaacgggatcgccctggaccacgaccgcaccggcagcggcccgcccgtcctcctgatcatggggagcggcgccgccaagtcggcctggcacctgcaccaggtgcccgcgctggtcgccgagggcttcgaggccgtcacgttcaccaaccgcggcgtccctcccagcggaggcggccccggcttcaccctcggcgacatggcggccgacaccgtcggcctgatcgagcacctcggcatcggcccctgcgcggtcgtggggatgtccctgggggccagggtcgcgcgcgaggtcgcccggacccgccccgacctggtctcccgatgcgtcctcgtggcgccgcgggcccgctcggaccggatgagggccgcctgcaccgccgccgagatcgccctcgccgacagcggcgtcaccctgccgccgcgctaccgcgcggtggtgcgggcgatgcagaacctctcgccgcggacgctcgcggacgaccggcagatcgccgactggctggacgtcctcgaactggcggcggccgacgggcccggcctgcgcacccagctggagctcagcgccgccgacgaccgcggggaggacctggccggcatcaccgccccctgccgggtgatcgccttcgccgacgacatcgtggcgccgccgcacctggcgaaggagatcgcggacgccctgcccgaggccgactaccacgtcgtccccgactgcggccactacggctacctggagcggcccgaccgggtcaaccggctcatcaccgaattcctccgcgcaccccagaccacacagggatga

SEQ ID NO: 53 - protein, 318 aa, Streptomyces refuineus
MKEHTMEPITPWRPAEISPGSHSLPATADALADFLRDSERIAGLLAAHKVLVLRGFGVGPQELEKIMPLLLPDRLAYVFGNSPRTKVGRNVYTSTEYPQEFTISMHSEMSYAAQWPARLLFYCERAAGSGGATPVVDNAAWYRALDREVREAFAGGLRYTQNLHGGRGLGKSWQDTFETEDRSEVEDYLSRSGATWQWNARNGLRVSHVRPATIEHPETGEPLWFNQSDQWHPATLGDEAAAALMEMLPPEELPQSVTFADGTPIPADYVRQVRDRGLEHAVDNDWRAGDLMLVDNVQAAHGRRPFTGDRRVLVAMSD

SEQ ID NO: 54 - DNA, 957 bp, Streptomyces refuineus
atgaaagagcacaccatggaaccgatcactccctggcggcccgccgagatcagcccgggcagccactccctccccgccaccgccgacgccctggccgacttcctgcgggactccgagcggatcgccgggctcctggccgcccacaaggtgctggtcctgcgcggtttcggcgtgggcccgcaggagctggagaagatcatgccgctcctgctgccggaccgcctggcgtacgtcttcggcaactccccgcgcaccaaggtggggcgcaacgtgtacacctccacggagtacccgcaggagttcaccatctcgatgcacagcgagatgtcctacgccgcgcagtggcccgcccggctgctgttctactgcgagcgggcggccgggagcggcggcgccacaccggtggtggacaacgccgcctggtaccgggcgctggaccgggaggtccgcgaggccttcgcgggcggcctgcgctacacccagaacctgcacgggggacggggcctgggcaagagctggcaggacaccttcgagaccgaggaccggtccgaggtcgaggactacctctcccggagcggcgccacctggcagtggaacgcgcgcaacgggctgcgggtcagccacgtccggcccgcgacgatcgagcacccggagacgggggaaccgctgtggttcaaccagtccgaccagtggcacccggccacgctcggcgacgaggccgccgccgcgctgatggagatgctgcccccggaggagctgccccagtcggtgaccttcgccgacggcaccccgataccggccgactacgtgcggcaggtgcgcgaccgcggactggagcacgcggtggacaacgactggcgggccggtgacctgatgctcgtcgacaacgtccaggcggcgcacggccgcaggccgttcaccggtgaccgccgggtcctggtcgccatgtcggactag

SEQ ID NO: 55 - protein, 269 aa, Streptomyces refuineus
MSIALADVEGVNRHETEFLYDEIFTRRGYLPEVLHLPEDPVVFDVGANIGMYTLFVKSERPGATVHSFEPVPSVYEVLCRNRERHGVAGLACPYGLAESEQEVEFTHYPGYSTMSTRSTLADTEAEKAFVREQVRTDHLPEAERMLDELLAFRFREQTVRCRLRPLSAVLDEHPVDRIDVLKIDVQRGEQQVLRGIEERHWPLVRQIAMEVHDSPGGVTAGRLAAVTDGLERRGFRVQAVQEDRYAGSDRYSVFAVSRHHGGRDAAGPS

SEQ ID NO: 56 - DNA, 810 bp, Streptomyces refuineus
atgagcatcgccctcgccgacgtggaaggcgtgaacaggcacgagaccgagttcctctacgacgagatcttcacccgccgcggttacctgccggaggtgctgcacctgccggaggaccccgtcgtcttcgacgtgggggccaacatcggcatgtacaccctcttcgtgaagtccgagagacccggtgccacggtccactccttcgaaccggtcccctcggtgtacgaggtcctgtgccgcaaccgggagcgccacggcgtggcggggctcgcctgcccctacggcctcgccgagagcgagcaggaggtcgagttcacccactacccgggctactcgaccatgtccacgcgcagcaccctggcggacaccgaggcggagaaggcgttcgtccgggaacaggtgcggaccgaccacctgcccgaggccgagcggatgctggacgaactcctggccttcaggttccgggagcagacggtgcgctgccggctccgtccgctctccgcggtcctcgacgagcaccccgtggaccggatcgacgtgctgaagatcgacgtgcagcgcggcgagcagcaggtgctgcggggcatcgaggaacggcactggccgctggtgcgccagatcgcgatggaggtgcacgacagccccggcggcgtcaccgccggccggctcgcagcggtgaccgacgggctggagcggcgcgggttccgcgtccaggccgtgcaggaggaccggtacgcgggcagcgaccgctactccgtgttcgccgtctcgcggcaccacggcggccgggacgcggcggggccctcctga

SEQ ID NO: 57 - protein, 319 aa, Streptomyces refuineus
MNPESRFELSDAERADVALLAEELTRTPPGLVDEREWLDRCRSLSCHLPARLQDRLRAFRHDPGRAGMLLIRNLPAAGSVPDTPREGDSVERRATLSASVLCAVSMELGEVVAYRNEKQGALVQNVVPVPGREDQQSNAGSVPLEMHTENAFHPHRPDYVGLLCVRSDHDRTAGLRVACVRAAMEHLDAGTRETLRRPLFTTEPPPSFERPDSGTKPHAVLTGDVEDPDIRIDFHATHATDPWGRQAMDALADAVRAVSEELVLDPADLVYVDNRVALHGRTAFTPRYDGEDRWLQRAFVHLDHRRSRAVRSLHGRVLS

SEQ ID NO: 58 - DNA, 960 bp, Streptomyces refuineus
atgaaccccgaaagccgcttcgaactgtccgacgccgagcgcgccgacgtcgcgctcctggcggaggagctgacgcgcacgccccccggcctggtggacgagcgggaatggctcgaccggtgccgcagcctctcctgccacctgcccgcccgcctccaggaccggctccgcgccttccgccacgaccccggccgcgcgggcatgctgctcatacgcaacctgcccgcggccgggtccgtgccggacaccccgcgggagggcgactcggtggaacgcagggcgacactgagcgcctcggtgctctgcgccgtctccatggaactgggcgaggtcgtcgcctaccgcaacgagaagcagggggcgctggtgcagaacgtggtgcccgtgcccggccgggaggaccagcagtccaacgccggctccgtcccgctggagatgcacaccgagaacgccttccacccccaccgccccgactacgtcgggctgctgtgcgtccgcagcgaccacgaccggaccgccggactccgggtggcctgcgtccgcgccgcgatggagcacctggacgccggaacccgcgagaccctgcggcgccccctgttcaccaccgaaccgccgccctccttcgagcgtccggacagcgggaccaagccgcacgccgtgctcaccggcgacgtggaggacccggacatccgcatcgacttccacgccacccacgcgacggacccgtggggcaggcaggccatggacgccctggccgacgccgtccgcgcggtctccgaggaactcgtcctggacccggccgatctggtgtacgtggacaaccgcgtcgcgctgcacgggcgtacggccttcaccccgcgctacgacggcgaggaccgctggctccagcgcgccttcgtccacctggaccaccggcgctcccgggccgtgcgctcgctgcacgggcgcgtgctgagctga

SEQ ID NO: 59 - protein, 340 aa, Streptomyces refuineus
MAADGAIHAAGLHKRFGAVHALQGVDLTVAQGEIMGLLGHNGAGKTTLVNILSTLTPPTSGTASVAGFDVAGRPEEVRRRIGVTGQFASLDEQLSGYDNLVLVARLCGASRAQAEDRAGELLEAFGLRGAGQRKAVTYSGGMRRRLDLALGLVGRPDVLFLDEPTVGLDLPSRIGLWEMVEDLTRGGTTVLLTTQYLEEADRLADRITVLGAGRVLVSGTAAELKSRAGSGSISLRLEPHGDPAAAAGALRRAGFPPSVAAARRELTVPAGGSADLATVIRVLDTVGQNVTEIRHSEPSLDDVYLALTGAEPHGPGPVEAARRTAPPKAHRPTGDTQETT

SEQ ID NO: 60 - DNA, 1023 bp, Streptomyces refuineus
atggccgcggacggagcgatccatgccgccggtctgcacaagcgcttcggagccgtccacgcgctccaaggcgtggacctgacggtggcccagggcgagatcatgggcctcctgggccacaatggcgcggggaagaccaccctcgtcaacatcctgtccaccctgacgccccccacgtcgggcaccgcctcggtcgccggcttcgacgtggccgggcgccccgaggaggtgcgccggcgcatcggcgtcaccgggcagttcgcctcgctcgacgagcagctctccggctacgacaacctcgtcctggtggcccggctgtgcggggcctcccgggcgcaggccgaggaccgggcgggcgagctgctggaggccttcgggctccgtggcgccgggcagcggaaggcggtgacctactcgggaggcatgcgccgccggctggacctggccctgggtctggtcgggcgccccgacgtgctgttcctggacgagccgaccgtcgggctggacctgcccagccgcatcggtctgtgggagatggtcgaggatctcacgcgcggcggtaccaccgtcctgctcaccacgcagtacctggaggaggcggaccggctcgccgaccgcatcaccgtcctgggagcgggccgggtcctggtctccggcacggcggccgagctgaagtcgcgggccggcagcggttccatctcgctcaggctcgaaccgcacggggatccggccgcggccgccggcgccctgcgccgggccgggttcccgcccagcgtggcggccgcccggcgcgagctgacggtgccggcgggcggctcggcggacctggccacggtgatccgggtgctggacaccgtcgggcagaacgtgaccgagatccgccactcggagccctccctggacgacgtctacctcgccctcaccggagcggagccccacggccccggcccggtggaggcggcgcgccggacggctcccccgaaggcgcaccggcccaccggcgacacgcaggagaccacgtga

SEQ ID NO: 61 - protein, 282 aa, Streptomyces refuineus
VNAPRTMAPPARPAAGPRGPRWRPTGRAAQLWILTARQIRLVYADRRVVLFSVAQPVVMLLLISQVFGSLADRSVLPRGVSYVEFLLPALLVTTGIGTSQSAGVGLVRDMEGGMVRRFRVLPLSLPLVLVARSIADLTRSGMQLLVLVAGGHLLFGYRAGGGLGGLVAALLLSTLVIWALIWIFIALAAWLRKVEVLSSIGFFVNFPLMFASSAFVPIEVLPGWLAAVATVNPVSYAVEASRGLALGGQVGSEVPAALCAGLGLMLAMMLLAARAFRRPPDE

SEQ ID NO: 62 - DNA, 849 bp, Streptomyces refuineus
gtgaacgcaccgcggacgatggcacccccggcccgccccgccgcggggccgcgcggcccgcgctggaggccgacgggcagagccgcgcagctgtggatcctcacggcgcgtcagatccgcctggtgtacgccgaccgcagggtcgtgctgttcagcgtggcccagccggtggtgatgctgctgctgatcagtcaggtcttcggcagcctcgcggaccgctccgtcctcccgcggggcgtgtcctacgtcgagttcctgctgccggccctgctggtcaccaccgggatcggcacctcgcagtccgcgggagtgggtctcgtgcgggacatggaaggcgggatggtgcgccgcttccgcgtcctcccgctgtcgctgccgctggtcctggtggcgcgctcgatcgccgacctgacccgctcggggatgcagctgctggtcctggtggccggcggccacctgctgttcggataccgggccgggggagggctggggggcctggtggcggcgctgctgctgtccaccctggtgatctgggccctgatctggatcttcatcgccctcgccgcgtggctgcgcaaggtggaggtgctctccagcatcggcttcttcgtcaacttcccgctgatgttcgcctccagcgcgttcgtgccgatcgaggtgctgcccggctggctggcggccgtcgccaccgtcaatcccgtgagctacgcggtggaggcgtcccgcggcctcgcgctgggagggcaggtcgggagcgaggtgcccgcggcgctgtgcgcgggcctcggcctgatgctggcgatgatgctgctcgccgcccgcgccttccgccggccgcccgacgagtga

SEQ ID NO: 63 - protein, 205 aa, Streptomyces refuineus
MAWIHDVLTAVSEMDPASRFALASAFAFAESGLGAGMFVPGEVAVLVLSAGTEGTRSLLALFLVVAVSSSAGDHIGYFLGIRYGERMRDTRLVRRIGQQHWDRAQALFHRYGATAVFLTRLLPIVRTLTPATAGVGSVRYFRFLPASLAGAAMWSALYVSAGSLVSASVREAETVVTRILWALLGVAAVLAVGVVWWRRRRRRAL

SEQ ID NO: 64 - DNA, 618 bp, Streptomyces refuineus
atggcatggatccacgatgtgctgacagcggtgtcggagatggatccggcctccagattcgcactggcctcggcgttcgctttcgcggaatcgggcctcggagcgggcatgttcgtccccggtgaggtcgcggtcctggtgctgagcgccggaacggaggggacccgttccctgctggcgctcttcctcgtcgtggcggtcagcagttcggccggcgaccacatcggctacttcctcggaatccgctacggggagcggatgcgggacacgcgcctggtgcggcggatcggccagcagcactgggaccgcgcccaggcgctcttccaccggtacggggcgaccgccgtcttcctgaccaggctgctgcccatcgtgcgcacgctcaccccggcgacggccggagtgggctcggtgcgctacttccgcttcctgccggcctcgctcgccggggccgcgatgtggtccgcgctctacgtgtcggcggggtcgctggtctcggcctccgtgcgggaggccgagaccgtggtcaccaggatcctgtgggcgctgctgggcgtggcggccgtcctggcggtcggcgtcgtgtggtggcgccggaggcgccgccgcgcgctctga

SEQ ID NO: 65 - protein, 376 aa, Streptomyces refuineus
MGLRVVCEQRRISAPHAVRVVDDETHRMTGLVEMQADALAETDFYLPSMTLEDYLRDAVPAHPVLKAAVDFGRPGADKALRALAATTTEFDSDDTGRGDSYRRAQRNSSVRWRGIRQLLELAAPSDAAAPHIVLDVLGGDGTIARAVHEHAPDLRDRVSILTGDLSGDMVERALAQGLPAVRQAADHLFLGDRTVDAALLAYGTHHIAPQDRLNAVTEALRVVRDGGRVVLHDFDDASPMARFFTDVVHPHTTAGHDYRHFSRGSLVELFEEAGTPARVVDLYDPLVVRGDTEEDARRRMCEYVADMYGVGEYFAAQGGTDARWRILERYFGHEGYLAGLPAEVDFTPRPVVYRSRGAYVAEVPRAAMVAVARKTA

SEQ ID NO: 66 - DNA, 1131 bp, Streptomyces refuineus
atgggattgcgggtcgtttgcgagcagcggaggatatccgccccgcacgcggtacgggtggtcgacgatgaaacccatcgaatgaccggattggtggaaatgcaggcggatgcactggcggagacggatttctacttgccgtccatgaccctcgaagactatctgcgggacgcggtgccggcccacccggtcctgaaggcggccgtggacttcggccgcccgggcgccgacaaggcgttgagggcgctggccgcgacgaccacggaattcgactccgacgacaccggacgcggcgactcctatcgccgggcgcagcggaactcgtcggtccgctggcggggcatacggcagctcctggaactggccgccccctccgacgcggcggccccccacatcgtcctggacgtcctcggaggggacgggaccatcgcgcgcgccgtccacgaacacgcccccgacctgcgggaccgcgtgagcatcctgacgggcgacctctccggcgacatggtcgaacgggccctcgcccagggcctgcccgccgtccggcaggcggcggaccacctcttcctgggggaccgcaccgtggacgcggcgctgctcgcctacggaacccaccacatcgcgccgcaggacaggctcaacgcggtcaccgaggccctgcgcgtcgtcagggacgggggccgggtcgtcctccacgacttcgacgacgccagccccatggcgcgcttcttcaccgacgtcgtccacccccacaccacggcgggccacgactaccggcacttctcgcgcggatcgctggtcgagctcttcgaggaggccgggacaccggctcgcgtcgtcgacctgtacgacccgctggtcgtccgcggcgacacggaggaggacgcccgccggcgcatgtgcgagtacgtggccgacatgtacggagtcggggagtacttcgccgcgcagggcgggaccgacgcccgctggcggatcctggagcggtacttcgggcacgagggctacctggcgggcctgcccgcggaggtcgacttcacaccgcgccccgtcgtctaccgctcccgcggcgcctacgtcgccgaggtgccccgtgcggcgatggtcgccgtcgcgcggaagacggcatga

The invention claimed is:

1. An isolated nucleic acid molecule, wherein said isolated nucleic acid molecule comprises a polynucleotide which encodes a domain of an A54145 nonribosomal peptide synthetase, wherein said A54145 nonribosomal peptide synthetase comprises the amino acid sequence of SEQ ID NO: 11, wherein said domain is selected from a condensation, an adenylation, a thiolation and an epimerization domain.

2. The isolated nucleic acid of claim 1, wherein said polynucleotide encodes a condensation domain comprising an amino acid sequence selected from the group consisting of amino acids 1–455, amino acids 1572–2014, amino acids 2620–3080, and amino acids 3700–4161 of SEQ ID NO: 11.

3. The isolated nucleic acid of claim 1, wherein said polynucleotide encodes an adenylation domain comprising an amino acid sequence selected from the group consisting of amino acids 491–998, amino acids 2040–2534, amino acids 3105–3614, and amino acids 4190–4679 of SEQ ID NO: 11.

4. The isolated nucleic acid of claim 1, wherein said polynucleotide encodes a thiolation domain comprising an amino acid sequence selected from the group consisting of amino acids 1002–1068, amino acids 2538–2605, amino acids 3618–3685, and amino acids 4683–4749 of SEQ ID NO: 11.

5. The isolated nucleic acid of claim 1, wherein said polynucleotide encodes an epimerization domain comprising amino acids 1071–1570 or amino acids 4752–5245 of SEQ ID NO: 11.

6. The isolated nucleic acid of claim 1, wherein said nucleic acid comprises a polynucleotide encoding an A54145 nonribosomal peptide synthetase domain comprising an amino acid sequence selected from the group consisting of: amino acids 1–455 of SEQ ID NO: 11; amino acids 491–998 of SEQ ID NO: 11; amino acids 1002–1068 of SEQ ID NO: 11; amino acids 1071–1570 of SEQ ID NO: 11; amino acids 1572–2014 of SEQ ID NO: 11; amino acids 2040–2534 of SEQ ID NO: 11; amino acids 2538–2605 of SEQ ID NO: 11; amino acids 2620–3080 of SEQ ID NO: 11;

amino acids 3105–3614 of SEQ ID NO: 11; amino acids 3618-3685 of SEQ ID NO: 11; amino acids 3700-4161 of SEQ ID NO: 11; amino acids 4190–4679 of SEQ ID NO: 11; amino acids 4683–4749 of SEQ ID NO: 11; and amino acids 4752–5245 of SEQ ID NO: 11.

7. The isolated nucleic acid of claim 1, wherein said nucleic acid comprises the polynucleotide of SEQ ID NO: 12.

8. The isolated nucleic acid of claim 2, wherein said polynucleotide is selected from the group consisting of residues 1–1365 of SEQ ID NO: 12; residues 4714–6042 of SEQ ID NO: 12; residues 7858–9240 of SEQ ID NO: 12; and residues 11098–12483 of SEQ ID NO: 12.

9. The isolated nucleic acid of claim 3, wherein said polynucleotide is selected from the group consisting of residues 1471–2994 of SEQ ID NO: 12; residues 6118–7602 of SEQ ID NO: 12; residues 9313–10842 of SEQ ID NO: 12; and residues 12568–14037 of SEQ ID NO: 12.

10. The isolated nucleic acid of claim 4, wherein said polynucleotide is selected from the group consisting of residues 3004–3204 of SEQ ID NO: 12; residues 7612–7815 of SEQ ID NO: 12; residues 10852–11055 of SEQ ID NO: 12; and residues 14047–14247 of SEQ ID NO: 12.

11. The isolated nucleic acid of claim 5, wherein said polynucleotide is selected from residues 3211–4710 of SEQ ID NO: 12 or residues 14254–15735 of SEQ ID NO: 12.

12. The isolated nucleic acid of claim 6, wherein said polynucleotide is selected from the group consisting of residues 1–1365 of SEQ ID NO: 12; residues 1471–2994 of SEQ ID NO: 12; residues 3004–3204 of SEQ ID NO: 12; residues 3211–4710 of SEQ ID NO: 12; residues 4714–6042 of SEQ ID NO: 12; residues 6118–7602 of SEQ ID NO: 12; residues 7612–7815 of SEQ ID NO: 12; residues 7858–9240 of SEQ ID NO: 12; residues 9313–10842 of SEQ ID NO: 12; residues 10852–11055 of SEQ ID NO: 12; residues 11098–12483 of SEQ ID NO: 12; residues 12568–14037 of SEQ ID NO: 12; residues 14047–14247 of SEQ ID NO: 12; and residues 14254–15735 of SEQ ID NO: 12.

13. An expression vector comprising the nucleic acid of claim 1.

14. A host cell transformed with an expression vector of claim 13.

15. The host cell of claim 14, wherein the cell is transformed with an exogenous nucleic acid comprising a gene cluster encoding polypeptides sufficient to direct the assembly of an A54145 compound.

16. A method of making a nonribosomal peptide synthetase domain, comprising transforming a host cell with an expression vector of claim 13, culturing said host cell under conditions such that a nonribosomal peptide synthetase domain is produced.

17. A method of preparing a nonribosomal peptide, comprising transforming a host cell with an expression vector of claim 13, culturing said host cell under conditions such that a nonribosomal peptide synthetase is produced and catalyzes the synthesis of said nonribosomal peptide.

* * * * *